US008168602B2

(12) United States Patent
DePinho et al.

(10) Patent No.: US 8,168,602 B2
(45) Date of Patent: May 1, 2012

(54) COMPOSITIONS, KITS AND METHODS FOR IDENTIFICATION, ASSESSMENT, PREVENTION AND THERAPY OF CANCER

(75) Inventors: Ronald A. DePinho, Brookline, MA (US); Giovanni Tonon, Milan (IT); Kwok-Kin Wong, Arlington, MA (US); Lynda Chin, Brookline, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 667 days.

(21) Appl. No.: 11/816,601

(22) PCT Filed: Feb. 17, 2006

(86) PCT No.: PCT/US2006/005584
§ 371 (c)(1),
(2), (4) Date: Feb. 20, 2009

(87) PCT Pub. No.: WO2006/089087
PCT Pub. Date: Aug. 24, 2006

(65) Prior Publication Data
US 2009/0297525 A1    Dec. 3, 2009

Related U.S. Application Data

(60) Provisional application No. 60/654,227, filed on Feb. 17, 2005, provisional application No. 60/690,064, filed on Jun. 13, 2005.

(51) Int. Cl.
*A61K 31/70* (2006.01)
*C07H 21/02* (2006.01)
*C07H 21/04* (2006.01)

(52) U.S. Cl. .............. 514/44 A; 514/44 R; 536/24.1; 536/24.5

(58) Field of Classification Search .............. 514/44
See application file for complete search history.

(56) References Cited

U.S. PATENT DOCUMENTS

| 5,783,683 A * | 7/1998 | Morrison ............ 536/24.5 |
| 6,602,713 B1 * | 8/2003 | Wyatt .................. 435/458 |
| 2009/0297536 A1 * | 12/2009 | Chin et al. ........... 424/172.1 |

FOREIGN PATENT DOCUMENTS
WO    WO 2005/089735    * 3/2005

OTHER PUBLICATIONS

Itoh et al. (1990) Biochemical and Biophysical Research Communications vol. 169, issue 2 pp. 680-685 (abstract).*
Karl Thiel. Nature biotechnology, vol. 22, No. 6, 2004, pp. 649-651.*
GenBank Accession No. AF332469. Downloaded from http://www.ncbi.nlm.nih.gov/nuccore/af332469 on Jun. 20, 2011.*

(Continued)

*Primary Examiner* — Terra Cotta Gibbs
(74) *Attorney, Agent, or Firm* — Foley Hoag LLP

(57) ABSTRACT

The invention relates to compositions, kits, and methods for detecting, characterizing, preventing, and treating human cancer. A variety of chromosomal regions (MCRs) and markers corresponding thereto, are provided, wherein alterations in the copy number of one or more of the MCRs and/or alterations in the amount, structure, and/or activity of one or more of the markers is correlated with the presence of cancer.

7 Claims, 12 Drawing Sheets

OTHER PUBLICATIONS

Branch, AD. TIBS. Feb. 1998. Volumn 23, pp. 45-50.*
Aguirre et al., "High-resolution characterization of the pancreatic adenocarcinoma genome," PNAS, 101(24):9067-9072 (2004).
Albertson et al., "Genomic microarrays in human genetic disease and cancer," Human Molecular Genetics, 12(2):R145-R152 (2003).
Anand et al., "AURORA-A amplification overrides the mitotic spindle assembly checkpoint, inducing resistance to Taxol," Cancer Cell, 3(1):51-62 (2003).
Angrand et al.,"NSD3, a new SET domain-containing gene, maps to Sp12 and is amplified in human breast cancer cell lines," Genomics, 74(1):79-88 (2001).
Armengol et al., "DNA Copy Number Changes and Evaluation of MYC, IGF1R, and FES Amplification in Xenografts of Pancreatic Andenocarcinoma," Cancer Genet. Cytogenet, 116:133-141 (2000).
Artandi et al., "Telomere dysfunction promotes non-reciprocal translocations and epithelial cancers in mice," Nature, 406(6796):641-645 (2000).
Balsara et al., "Chromosomal imbalances in human lung cancer," Oncogene, 21:6877-6883 (2002).
Bardelli et al., "Mutational analysis of the tyrosine kimone in colorectal cancers," Science, 300(5621):949 (2003).
Bardi et al., "Karyotypic abnormalities in tumours of the pancreas," Br. J. Cancer, 67:1106-1112 (1993).
Bhattacharjee et al., "Classification of human lung carcinomas by mRNA expression profiling reveals distinct adenocarcinoma subclasses," PNAS, 98(24):13790-13795 (2001).
Bignall et al., "High Resolution Analysis of DNA Copy Number Using Oligonucleotide Microarrays," Genome Research, 14:287-295 (2004).
Bischoff et al., "A homologue of *Drosophila aurora* kinase is oncogenic and amplified in human colorectal cancers," The EMBO Journal, 17(11):3052-3065 (1998).
Bjorkqvist et al., "Comparison of DNA copy number changes in malignant mesothelioma, adenocarcinoma and large-cell anaplastic carcinoma of the lung," British Journal of Cancer, 77(2):260-269 (1998).
Bjorkqvist et al., "DNA gains in 3q occur frequently in squamous cell carcinoma of the lung, but not in adenocarcinoma," Genes Chromosomes Cancer, 22(1):79-82 (1998).
Bold et al., "BCL2 Expression Correlates with Metastatic Potential in Pancreatic Cancer Cell Lines," Cancer, 92:1122-1129 (2001).
Brennan et al., "High-Resolution Global Profiling of Genomic Alterations with Long Oligonucleotide Microarray," Cancer Research, 64:4744-4748 (2004).
Calin et al., "Human microRNA genes are frequently located at fragile sites and genomic regions involved in cancers," PNAS, 101(9):2999-3004 (2004).
Calin et al.,"MicroRNA profiling reveals distinct signatures in B cell chronic lymphocytic leukemias," PNAS, 101(32):11755-11760 (2004).
Chen et al., "Gene Expression Patterns in Human Liver Cancers," Molecular Biology of the Cell, 13:1929-1939 (2002).
Chin et al., "In situ analyses of genome instability in breast cancer," Nat. Genet., 36(9):984-988 (2004).
Curtis et al., "Amplification of DNA Sequences from Chromosomes 19q13.1 in Human Pancreatic Cell Lines," Genomics, 53:42-55 (1998).
Dhanasekaran et al., "Delineation of prognostic biomarkers in prostate cancer," Nature, 412:822-826 (2001).
Dib et al., "Characterization of the region of the short arm of chromosome 8 amplified in breast carcinoma," Oncogene, 10(5):995-1001 (1995).
Ebert et al., "Expression of cysteine protease inhibitors stefin A, stefin B, and cystatin C in human lung tumor tissue," Adv. Exp. Med. Biol., 421:259-265 (1997).
Edwards et al., "Gene Amplifications Associated with the Development of Hormone-Resistant Prostate Cancer," Clinical Cancer Research, 9:5271-5281 (2003).
Endele et al.,"LETM1, a novel gene encoding a putative EF-hand Ca(2+)-binding protein, flanks the Wolf-Hirschhorn syndrome (WHS) critical region and is deleted in most WHS patients," Genomics, 60(2):218-225 (1999).
Estilo et al., "The Role of Novel Oncogenes *Squamous Cell Carcinoma-related Oncogene* and *Phosphatidylinositol 3-Kinase p110α* in Squamous Cell Carcinoma of the Oral Tongue," Clinical Cancer Research, 9:2300-2306 (2003).
Fukushige et al., "Frequent Gain of Copy Number on the Long Arm of Chromosome 20 in Human Pancreatic Adenocarcinoma," Genes, Chromosomes & Cancer, 19:161-169 (1997).
Futreal et al., "A Census of Human Cancer Genes," Nat. Rev. Cancer, 4(3):177-183 (2004).
Garber et al., "Diversity of gene expression in adenocarcinoma of the lung," PNAS, 98(24):13784-13789 (2001).
Ghadimi et al., "Specific Chromosomal Aberrations and Amplification of the A1B1 Nuclear Receptor Coactivator Gene in Pancreatic Carcinomas," American Journal of Pathology, 154(2):525-536 (1999).
Ginzinger, D., "Gene quantification using real-time quantitative PCR: An emerging technology hits the mainstream," Experimental Hematology, 30:503-512 (2002).
Golub et al., "Molecular Classification of Cancer: Class Discovery and Class Prediction by Gene Expression Monitoring," Science, 286:531-537 (1999).
Gorunova et al., "Cytogenetic Analysis of Pancreatic Carcinomas: Intratumor Heterogeneity and Nonrandom Pattern of Chromosome Aberrations," Genes, Chromosomes & Cancer, 23:81-99 (1998).
Gorunova et al., "Massive Cytogenetic Heterogeneity in a Pancreatic Carcinoma: Fifty-Four Karyotypically Unrelated Clones," Genes, Chromosomes & Cancer, 14:259-266 (1995).
Griffin et al., "Chromosome Abnormalities in Pancreatic Adenocarcinoma," Genes, Chromosomes & Cancer, 9:93-100 (1994).
Griffin et al., "Consistent Chromosome Abnormalities in Adenocarcinoma of the Pancreas," Cancer Research, 55:2394-2399 (1995).
Gruss et al., "Chromosome-induced microtubule assembly mediated by TPX2 is required for spindle formation in HeLa cells," Nat. Cell Biol., 4(11):871-879 (2002).
Hahn et al.,"Allelotype of Pancreatic Adenocarcinoma Using Xenograft Enrichment," Cancer Research, 55:4670-4675 (1995).
Heidebrecht et al., "repp86: A Human Protein Associated in the Progression of Mitosis," Molecular Cancer Research, 1:271-279 (2003).
Huang et al., "Genetic differences detected by comparative genomic hybridization in head and neck squamous cell carcinomas from different tumor sites: construction of oncogenetic trees for tumor progression," Genes, Chromosomes & Cancer, 34(2):224-233 (2002).
Hyman et al., "Impact of DNA Amplification on Gene Expression Patterns in Breast Cancer," Cancer Research, 62:6240-6245 (2002).
Jaju et al., "A novel gene, *NSD1*, is fused to *NUP98* in the t(5;11)(q35;pl5.5) in de novo childhood acute myeloid leukemia," Blood, 98(4):1264-1267 (2001).
Johansson et al., "Nonrandom Chromosomal Rearrangements in Pancreatic Carcinomas," Cancer, 69(7):1674-1681 (1992).
Kallioniemi et al., "Optimizing comparative genomic hybridization for analysis of DNA sequence copy number changes in solid tumors," Genes, Chromosomes & Cancer, 10(4):231-243 (1994).
Kanazawa et al., "Transition from Squamous Cell Carcinoma to Adenocarcinoma in Adenosquamous Carcinoma of the Lung," American Journal of Pathology, 156(4):1289-1298 (2000).
Kawasaki et al., "11q23-24 loss is associated with chromosomal instability in endometrial cancer," International Journal of Molecular Medicine, 12:727-731 (2003).
Kimura et al., "Detailed Deletion Mapping on Chromosome Arm 12q in Human Pancreatic Adenocarcinoma: Identification of a 1-cM Region of Common Allelic Loss," Genes, Chromosomes & Cancer, 17:88-93 (1996).
Kimura et al., "Genetic alterations in 102 primary gastric cancers by comparative genomic hybridization: gain of 20q and loss of 18q are associated with tumor progression," Modern Pathology, 17:1328-1337 (2004).

Kinouchi et al., "Telomere shortening in the colonic mucosa of patients with ulcerative colitis," J. Gastroenterol., 33(3):343-348 (1998).

Koster et al., "p63 is the molecular switch for initiation of an epithelial stratification program," Genes & Development, 18:126-131 (2004).

Krams et al., "Repp86 expression and outcome in patients with neuroblastoma," J. Clin. Oncol., 21(9):1810-1818 (2003).

LaTulippe et al., "Comprehensive Gene Expression Analysis of Prostate Cancer Reveals Distinct Transcriptional Programs Associated with Metastatic Disease," Cancer Research, 62:4499-4506 (2002).

Li et al., "Model-based analysis of oligonucleotide arrays: Expression index computation and outlier detection," PNAS, 98(1):31-36 (2001).

Lucito et al., "Representational Oligonucleotide Microarray Analysis: A High-Resolution Method to Detect Genome Copy Number Variation," Genome Research, 13:2291-2305 (2003).

Luk et al., "Molecular cytogenetic analysis of non-small cell lung carcinoma by spectral karyotyping and comparative genomic hybridization," Cancer Genetics and Cytogenetics, 125:87-99 (2001).

Lynch et al., "Activating Mutations in the Epidermal Growth Factor Receptor Underlying Responsiveness of Non-Small-Cell Lung Cancer to Gefitinib," N. Engl. J. Med., 350(21):2129-2139 (2004).

Mahlamaki et al., "Comparative Genomic Hybridization Reveals Frequent Gains of 20q, 8q, 11q, 12p, and 17q, and Losses of 18q, 9p, and 15q in Pancreatic Cancer," Genes, Chromosomes & Cancer, 20:383-391 (1997).

Mahlamaki et al., "Frequent Amplification of 8q24, 11q, 17q, and 20q-Specific Genes in Pancreatic Cancer," Genes, Chromosomes & Cancer, 35:353-358 (2002).

Manda et al., "Identification of genes (SPON2 and C20orf2) differentially expressed between cancerous and noncancerous lung cells by mRNA differential display," Genomics, 61(1):5-14 (1999).

Mao et al., "Genomic Alterations in Blastic Natural Killer/Extranodal Natural Killer-Like T Cell Lymphoma with Cutaneous Involvement," J Invest Dermatol, 121:618-627 (2003).

Massion et al., "Genomic Copy Number Analysis of Non-small Cell Lung Cancer Using Array Comparative Genomic Hybridization: Implications of the Phosphatidylinositol 3-Kinase Pathway," Cancer Research, 62:3636-3640 (2002).

Massion et al., "Significance of p63 Amplification and Overexpression in Lung Cancer Development and Prognosis," Cancer Research, 63:7113-7121 (2003).

McKeon, F., "p63 and the epithelial stem cell: more than status quo?" Genes & Development, 18:465-469 (2004).

Metzler et al., "High expression of precursor microRNA-155/BIC RNA in children with Burkitt lymphoma," Genes, Chromosomes & Cancer, 39(2):167-169 (2003).

Mills et al., "p63 is a p53 homologue required for limb and epidermal morphogenesis," Nature, 398:708-713 (1999).

Minna et al., "Focus on lung cancer," Cancer Cell, 1(1):49-52 (2002).

Nakagawa et al., "Poor prognosis after lung resection for patients with adenosquamous carcinoma of the lung," Ann. Thorac. Surg., 75(6):1740-1744 (2003).

Nilsson et al., "Amplification of Chromosome 1 Sequences in Lipomatous Tumors and Other Sarcomas," Int. J. Cancer, 109:363-369 (2004).

Nowikovsky et al., "The LETM1/YOL027 Gene Family Encodes a Factor of the Mitochondrial $K^+$ Homeostasis with a Potential Role in the Wolf-Hirschhorn Syndrome," The Journal of Biological Chemistry, 279(29):30307-30315 (2004).

Olshen et al., "Change-Point Analysis of Array-Based Comparative Genomic Hybridization Data," ASA Proceedings of the Joint Statistical Meetings, 2530-2535 (2002).

Olshen et al., "Circular binary segmentation for the analysis of array-based DNA copy number data," Biostatistics, 5(4):557-572 (2004).

O'Sullivan et al., "Chromosomal instability in ulcerative colitis is related to telomere shortening," Nature Genetics, 32:280-284 (2002).

Paez et al., "EGFR Mutations in Lung Cancer: Correlation with Clinical Response to Gefitinib Therapy," Science, 304:1497-1500 (2004).

Pei et al., "Genomic Imbalances in Human Lung Adenocarcinomas and Squamous Cell Carcinomas," Genes, Chromosomes & Cancer, 31:282-287 (2001).

Pernu et al., "Cystatin A and B in the development of human squamous epithelia," Acta Histochem., 88(1):53-57 (1990).

Petersen et al., "Patterns of Chromosomal Imbalances in Adenocaracinoma and Squamous Cell Carcinoma of the Lung," Cancer Research, 57:2331-2335 (1997).

Pinkel et al., "High resolution analysis of DNA copy number variation using comparative genomic hybridization to microarrays," Nature Genetics, 20:207-211 (1998).

Pollack et al., "Genome-wide analysis of DNA copy-number changes using cDNA microarrays," Nature Genetics, 23:41-46 (1999).

Pollack et al., "Microarray analysis reveals a major direct role of DNA copy number alteration in the transcriptional program of human breast tumors," PNAS, 99(20):12963-12968 (2002).

Protopopov et al., "Human chromosome 3: high-resolution fluorescence in situ hybridization mapping of 40 unique NotI linking clones homologous to genes and cDNAs," Chromosome Research, 4:443-447 (1996).

Ray et al., "Genomic and Expression Analysis of the 8p11-12 Amplicon in Human Breast Cancer Cell Lines," Cancer Research, 64:40-47 (2004).

Rhodes et al.,"ONCOMINE: A Cancer Microarray Database and Integrated Data-Mining Platform," Neoplasia, 6(1):1-6 (2004).

Romanov et al., "Normal human mammary epithelial cells spontaneously escape senescence and acquire genomic changes," Nature, 409:633-637 (2001).

Rosati et al.,"NUP98 is fused to the NSD3 gene in acute myeloid leukemia associated with t(8;11)(p11.2;p15)," Blood, 99(10):3857-3860 (2002).

Samuels et al., "High frequency of mutations of teh PIK3CA gene in human cancers," Science, 304:554 (2004).

Sanchez-Cespedes et al., "Chromosomal Alterations in Lung Adenocarcinoma from Smokers and Nonsmokers," Cancer Research, 61:1309-1313 (2001).

Schneider et al., "Unsafe SETs: histone lysine methyltransferases and cancer," Trends Biochem. Sci., 27(8):396-402 (2002).

Seymour et al.,"Allelotype of Pancreatic Adenocarcinoma," Cancer Research, 54:2761-2764 (1994).

Simon et al., "High-Throughput Tissue Microarray Analysis of 3p25 (RAF1) and 8p12 (FGFR1) Copy Number Alterations in Urinary Bladder Cancer," Cancer Research, 61:4514-4519 (2001).

Solinas-Toldo et al., "Mapping of Chromosomal Imbalances in Pancreatic Carcinoma by Comparative Genomic Hybridization," Cancer Research, 56:3803-3807 (1996).

Sridhar et al., "The increasing recognition of adenosquamous lung carcinoma," Am. J. Clin. Oncol., 15(4):356-362 (1992).

Stec et al.,"WHSC1, a 90 kb SET domain-containing gene, expressed in early development and homologous to a *Drosophila* dysmorphy gene maps in the Wolf-Hirschhorn syndrome critical region and is fused to IgH in T(4;14) multiple myeloma," Human Molecular Genetics, 7(7):1071-1082 (1998).

Storey et al., "Statistical significance for genomewide studies," PNAS, 100(16):9440-9445 (2003).

Ten Have-Opbroek et al., "The alveolar type II cell is a pluripotential stem cell in the genesis of human adenocarcinomas and squamous cell carcinomas," Histol. Histopathol., 12(2):319-336 (1997).

Trauzold et al., "Multiple and synergistic deregulations of apoptosis-controlling genes in pancreatic carcinoma cells," British Journal of Cancer, 89:1714-1721 (2003).

Tusher et al., "Significance analysis of microarrays applied to the ionizing radiation response," PNAS, 98(9):5116-5121 (2001).

Wang et al., "Identification and Characterization of a Novel Androgen Receptor Coregulator ARA267-α in Prostate Cancer Cells," The Journal of Biological Chemistry, 276(44):40417-40423 (2001).

Wang et al., "Loss of Heterozygosity and Its Correlation with Expression Profiles in Subclasses of Invasive Breast Cancers," Cancer Research, 64:64-71 (2004).

Wang et al., "Mutational analysis of the tyrosine phosphatome in colorectal cancers," Science, 304:1164-1166 (2004).

Westfall et al., "p63: molecular complexity in development and cancer," Carcinogenesis, 25(6):857-864 (2004).

Wolf et al., "High-Resolution Analysis of Gene Copy Number Alterations in Human Prostate Cancer Using CGH on cDNA Microarrays: Impact of Copy Number on Gene Expression," Neoplasia, 6(3):240-247 (2004).

Xu et al.,"Bcl-x(L) antisense oligonucleotides induce apoptosis and increase sensitivity of pancreatic cancer cells to gemcitabine," Int. J. Cancer, 94(2):268-274 (2001).

Yang et al., "p63 is essential for regnerative proliferation in limb, craniofacial and epithelial development," Nature, 398:714-718 (1999).

Zhao et al., "An Integrated View of Copy Number and Allelic Alterations in the Cancer Genome Using Single Nucleotide Polymorphism Arrays," Cancer Research, 64:3060-3071 (2004).

* cited by examiner

A: aCGH

B: expression ns, KITS AND METHODS FOR
IDENTIFICATION, ASSESSMENT,
PREVENTION AND THERAPY OF CANCER

RELATED APPLICATIONS

This application claim the benefit of U.S. provisional application No. 60/654,227, filed Feb. 17, 2005 and U.S. provisional application No. 60/690,064, filed Jun. 13, 2005; the contents of each application is incorporated herein in its entirety by this reference.

GOVERNMENT FUNDING

Work described herein was supported, at least in part, by National Institutes of Health (NIH) under grants K08AG 2400401, R01CA099041, R01CA84628, P01CA95616 and U01CA84313. The government may therefore have certain rights to this invention.

SEQUENCE LISTING

The instant application contains a "lengthy" Sequence Listing which has been submitted via CD-R in lieu of a printed paper copy, and is hereby incorporated by reference in its entirety. Said CD-R, recorded on Feb. 17, 2006, are labeled "CRF", "Copy 1", "Copy 2", and "Copy 3" respectively, and each contains only one identical 2.03 MB file (DFS06425.txt).

BACKGROUND OF THE INVENTION

Cancer represents the phenotypic end-point of multiple genetic lesions that endow cells with a full range of biological properties required for tumorigenesis. Indeed, a hallmark genomic feature of many cancers, including, for example, lung cancer, breast cancer, ovarian cancer, and colon cancer, is the presence of numerous complex chromosome structural aberrations—including non-reciprocal translocations, amplifications and deletions.

Karyotype analyses (Johansson, B., et al. (1992) *Cancer* 69, 1674-81; Bardi, G., et al. (1993) *Br J Cancer* 67, 1106-12; Griffin, C. A., et al. (1994) *Genes Chromosomes Cancer* 9, 93-100; Griffin, C. A., et al. (1995) *Cancer Res* 55, 2394-9; Gorunova, L., et al. (1995) *Genes Chromosomes Cancer* 14, 259-66; Gorunova, L., et al. (1998) *Genes Chromosomes Cancer* 23, 81-99), chromosomal CGH and array CGH (Wolf M et al. (2004) *Neoplasia* 6(3)240; Kimura Y, et al. (2004) *Mod. Pathol.* 21 May (epub); Pinkel, et al. (1998) *Nature Genetics* 20:211; Solinas-Toldo, S., et al. (1996) *Cancer Res* 56, 3803-7; Mahlamaki, E. H., et al. (1997) *Genes Chromosomes Cancer* 20, 383-91; Mahlamaki, E. H., et al. (2002) *Genes Chromosomes Cancer* 35, 353-8; Fukushige, S., et al. (1997) *Genes Chromosomes Cancer* 19:161-9; Curtis, L. J., et al. (1998) *Genomics* 53, 42-55; Ghadimi, B. M., et al. (1999) *Am J Pathol* 154, 525-36; Armengol, G., et al. (2000) *Cancer Genet Cytogenet* 116, 133-41), fluorescence in situ hybridization (FISH) analysis (Nilsson M et al. (2004) *Int J Cancer* 109(3):363-9; Kawasaki K et al. (2003) Int J Mol. Med. 12(5):727-31) and loss of heterozygosity (LOH) mapping (Wang Z C et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93) have identified recurrent regions of copy number change or allelic loss in various cancers. For example, in lung cancer, frequent gains have been mapped to 1q31, 3q25-27, 5p13-14 and 8q23-24 and losses to 3p21, 8p22, 9p21-22, 13q22, and 17p12-13 (Bjorkqvist, A. M., et al. (1998) *Br J Cancer* 77, 260-9; Luk, C., et al. (2001) *Cancer Genet Cytogenet* 125, 87-99; Pei, J., et al. (2001) *Genes Chromosomes Cancer* 31, 282-7; Petersen, I., et al. (1997) *Cancer Res* 57, 2331-5; Balsara, B. R. & Testa, J. R. (2002) *Oncogene* 21, 6877-83). In some instances, validated oncogenes and tumor suppressor genes residing within these loci have been identified, including MYC (8q24), p16$^{INK4A}$ (9p21), RB1 (13q14), RASSF1 (3p21), TUSC2 (3p21), SEMA3B (3p21), FHIT (3p14), and KRAS2 (12p12). However, for the majority of amplified and deleted loci and resident genes, the presumed cancer-relevant targets remain to be discovered.

SUMMARY OF THE INVENTION

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a novel cDNA or oligomer-based platform and bioinformatics tools which allowed for the high-resolution characterization of copy-number alterations in the lung cancer genome (see Example 1). The present invention is based, also in part, on the identification of markers residing within the MCRs of the invention, which are also associated with cancer.

Accordingly, in one aspect, the present invention provides methods of assessing whether a subject is afflicted with cancer or at risk for developing cancer, comprising comparing the copy number of an MCR in a subject sample to the normal copy number of the MCR, wherein the MCR is selected from the group consisting of the MCRs listed in Tables 3 and/or 7, and wherein an altered copy number of the MCR in the sample indicates that the subject is afflicted with cancer or at risk for developing cancer. In one embodiment, the copy number is assessed by fluorescent in situ hybridization (FISH). In another embodiment, the copy number is assessed by quantitative PCR (qPCR). In yet another embodiment, the copy number is assessed by FISH plus spectral karotype (SKY). In still another embodiment, the normal copy number is obtained from a control sample. In yet another embodiment, the sample is selected from the group consisting of tissue, whole blood, serum, plasma, buccal scrape, saliva, cerebrospinal fluid, urine, stool, bronchoalveolar lavage, and lung tissue.

In another aspect, the invention provides methods of assessing whether a subject is afflicted with cancer or at risk for developing cancer comprising comparing the amount, structure, and/or activity of a marker in a subject sample, wherein the marker is a marker which resides in an MCR listed in Tables 3 and/or 7, and the normal amount, structure, and/or activity of the marker, wherein a significant difference between the amount, structure, and/or activity of the marker in the sample and the normal amount, structure, and/or activity is an indication that the subject is afflicted with cancer or at risk for developing cancer. In one embodiment, the marker is selected from the group consisting of the markers listed in Tables 1 or 2. In another embodiment, the amount of the marker is determined by determining the level of expression of the marker. In yet another embodiment, the level of expression of the marker in the sample is assessed by detecting the presence in the sample of a protein corresponding to the marker. The presence of the protein may be detected using a reagent which specifically binds with the protein. In one embodiment, the reagent is selected from the group consisting of an antibody, an antibody derivative, and an antibody fragment. In another embodiment, the level of expression of the marker in the sample is assessed by detecting the presence in the sample of a transcribed polynucleotide or portion thereof, wherein the transcribed polynucleotide comprises the marker. In one embodiment, the transcribed polynucleotide is an mRNA or cDNA. The level of expression of the marker in the sample may also be assessed by detecting the presence in the sample of a transcribed polynucleotide which anneals with the marker or anneals with a portion of a polynucleotide wherein the polynucleotide comprises the marker, under stringent hybridization conditions.

In another embodiment, the amount of the marker is determined by determining copy number of the marker. The copy number of the MCRs or markers may be assessed by comparative genomic hybridization (CGH), e.g., array CGH. In still another embodiment, the normal amount, structure, and/or activity is obtained from a control sample. In yet another embodiment, the sample is selected from the group consisting of tissue, whole blood, serum, plasma, buccal scrape, saliva, cerebrospinal fluid, urine, stool, bronchoalveolar lavage, and lung tissue.

In another aspect, the invention provides methods for monitoring the progression of cancer in a subject comprising a) detecting in a subject sample at a first point in time, the amount and/or activity of a marker, wherein the marker is a marker which resides in an MCR listed in Tables 3 and/or 7; b) repeating step a) at a subsequent point in time; and c) comparing the amount and/or activity detected in steps a) and b), and therefrom monitoring the progression of cancer in the subject. In one embodiment, the marker is selected from the group consisting of the markers listed in Tables 1 or 2. In another embodiment, the sample is selected from the group consisting of tissue, whole blood, serum, plasma, buccal scrape, saliva, cerebrospinal fluid, urine, stool, bronchoalveolar lavage, and lung tissue. In still another embodiment, the sample comprises cells obtained from the subject. In yet another embodiment, between the first point in time and the subsequent point in time, the subject has undergone treatment for cancer, has completed treatment for cancer, and/or is in remission.

In still another aspect, the invention provides methods of assessing the efficacy of a test compound for inhibiting cancer in a subject comprising comparing the amount and/or activity of a marker in a first sample obtained from the subject and maintained in the presence of the test compound, wherein the marker is a marker which resides in an MCR listed in Tables 3 and/or 7, and the amount and/or activity of the marker in a second sample obtained from the subject and maintained in the absence of the test compound, wherein a significantly higher amount and/or activity of a marker in the first sample which is deleted in cancer, relative to the second sample, is an indication that the test compound is efficacious for inhibiting cancer, and wherein a significantly lower amount and/or activity of the marker in the first sample which is amplified in cancer, relative to the second sample, is an indication that the test compound is efficacious for inhibiting cancer in the subject. In one embodiment, the first and second samples are portions of a single sample obtained from the subject. In another embodiment, the first and second samples are portions of pooled samples obtained from the subject. In one embodiment, the marker is selected from the group consisting of the markers listed in Tables 1 or 2.

In yet another aspect, the invention provides methods of assessing the efficacy of a therapy for inhibiting cancer in a subject comprising comparing the amount and/or activity of a marker in the first sample obtained from the subject prior to providing at least a portion of the therapy to the subject, wherein the marker is a marker which resides in an MCR listed in Tables 3 and/or 7, and the amount and/or activity of the marker in a second sample obtained from the subject following provision of the portion of the therapy, wherein a significantly higher amount and/or activity of a marker in the first sample which is deleted in cancer, relative to the second sample, is an indication that the test compound is efficacious for inhibiting cancer and wherein a significantly lower amount and/or activity of a marker in the first sample which is amplified in cancer, relative to the second sample, is an indication that the therapy is efficacious for inhibiting cancer in the subject. In one embodiment, the marker is selected from the group consisting of the markers listed in Tables 1 or 2.

Another aspect of the invention provides methods of selecting a composition capable of modulating cancer comprising obtaining a sample comprising cancer cells; contacting said cells with a test compound; and determining the ability of the test compound to modulate the amount and/or activity of a marker, wherein the marker is a marker which resides in an MCR listed in Tables 3 and/or 7, thereby identifying a modulator of cancer. In one embodiment, the marker is selected from the group consisting of the markers listed in Tables 1 or 2. The cells may be isolated from, e.g., an animal model of cancer, a cancer cell line, e.g., a lung cancer cell line originating from a lung tumor, or from a subject suffering from cancer.

Yet another aspect of the invention provides methods of selecting a composition capable of modulating cancer comprising contacting a marker with a test compound; and determining the ability of the test compound to modulate the amount and/or activity of a marker, wherein the marker is a marker which resides in an MCR listed in Tables 3 and/or 7, thereby identifying a composition capable of modulating cancer. In one embodiment, the marker is selected from the group consisting of the markers listed in Tables 1 or 2. In another embodiment, the method further comprises administering the test compound to an animal model of cancer. In still another embodiment, the modulator inhibits the amount and/or activity of a gene or protein corresponding to a marker set forth in Table 2 which is amplified, e.g., a marker selected from the markers listed in Table 2. In yet another embodiment, the modulator increases the amount and/or activity of a gene or protein corresponding to a marker set forth in Table 1 which is deleted, e.g., a marker selected from the markers listed in Table 1.

In another aspect, the invention provides kits for assessing the ability of a compound to inhibit cancer comprising a reagent for assessing the amount, structure, and/or activity of a marker, wherein the marker is a marker which resides in an MCR listed in Tables 3 and/or 7. In one embodiment, the marker selected from the group consisting of the markers listed in Tables 1 or 2.

The invention also provides kits for assessing whether a subject is afflicted with cancer comprising a reagent for assessing the copy number of an MCR selected from the group consisting of the MCRs listed in Tables 3 and/or 7, as well as kits for assessing whether a subject is afflicted with cancer, the kit comprising a reagent for assessing the amount, structure, and/or activity of a marker. In one embodiment, the marker selected from the group consisting of the markers listed in Tables 1 or 2.

In another aspect, the invention provides kits for assessing the presence of human cancer cells comprising an antibody or fragment thereof, wherein the antibody or fragment thereof specifically binds with a protein corresponding to a marker, wherein the marker is a marker which resides in an MCR listed in Tables 3 and/or 7. In one embodiment, the marker selected from the group consisting of the markers listed in Tables 1 or 2.

In still another aspect, the invention provides kits for assessing the presence of cancer cells comprising a nucleic acid probe wherein the probe specifically binds with a transcribed polynucleotide corresponding to a marker, wherein the marker is a marker which resides in an MCR listed in Tables 3 and/or 7. In one embodiment, the marker selected from the group consisting of the markers listed in Tables 1 or 2.

In yet another aspect, the invention provides methods of treating a subject afflicted with cancer comprising administering to the subject a modulator of the amount and/or activity of a gene or protein corresponding to a marker, wherein the marker is a marker which resides in an MCR listed in Tables 3 and/or 7. In one embodiment, the marker selected from the group consisting of the markers listed in Tables 1 or 2.

The invention also provides methods of treating a subject afflicted with cancer comprising administering to the subject a compound which inhibits the amount and/or activity of a gene or protein corresponding to a marker which resides in an MCR listed in Tables 3 and/or 7 which is amplified in cancer, e.g., a marker selected from the markers listed in Table 2, thereby treating a subject afflicted with cancer. In one embodiment, the compound is administered in a pharmaceutically acceptable formulation. In another embodiment, the compound is an antibody or an antigen binding fragment thereof, which specifically binds to a protein corresponding to the marker. For example, the antibody may be conjugated to a toxin or a chemotherapeutic agent. In still another embodiment, the compound is an RNA interfering agent, e.g., an siRNA molecule or an shRNA molecule, which inhibits expression of a gene corresponding to the marker. In yet another embodiment, the compound is an antisense oligonucleotide complementary to a gene corresponding to the marker. In still another embodiment, the compound is a peptide or peptidomimetic, a small molecule which inhibits activity of the marker, e.g., a small molecule which inhibits a protein-protein interaction between a marker and a target protein, or an aptamer which inhibits expression or activity of the marker.

In another aspect, the invention provides methods of treating a subject afflicted with cancer comprising administering to the subject a compound which increases expression or activity of a gene or protein corresponding to a marker which resides in an MCR listed in Tables 3 and/or 7 which is deleted in cancer, e.g., a marker selected from the markers listed in Table 1, thereby treating a subject afflicted with cancer. In one embodiment, the compound is a small molecule. The invention also includes methods of treating a subject afflicted with cancer comprising administering to the subject a protein corresponding to a marker, e.g., a marker selected from the markers listed in Table 1, thereby treating a subject afflicted with cancer. In one embodiment, the protein is provided to the cells of the subject, by a vector comprising a polynucleotide encoding the protein. In still another embodiment, the compound is administered in a pharmaceutically acceptable formulation.

The present invention also provides isolated proteins, or fragments thereof, corresponding to a marker selected from the markers listed in Tables 1 or 2.

In another aspect, the invention provides isolated nucleic acid molecules, or fragments thereof, corresponding to a marker selected from the markers listed in Tables 1 or 2.

In still another aspect, the invention provides isolated antibodies, or fragments thereof, which specifically bind to a protein corresponding to a marker selected from the markers listed in Tables 1 or 2.

In yet another aspect, the invention provides an isolated nucleic acid molecule, or fragment thereof, contained within an MCR selected from the MCRs listed in Tables 3 and/or 7, wherein said nucleic acid molecule has an altered amount, structure, and/or activity in cancer. The invention also provides an isolated polypeptide encoded by the nucleic acid molecules.

BRIEF DESCRIPTION OF THE TABLES

Figure 1:
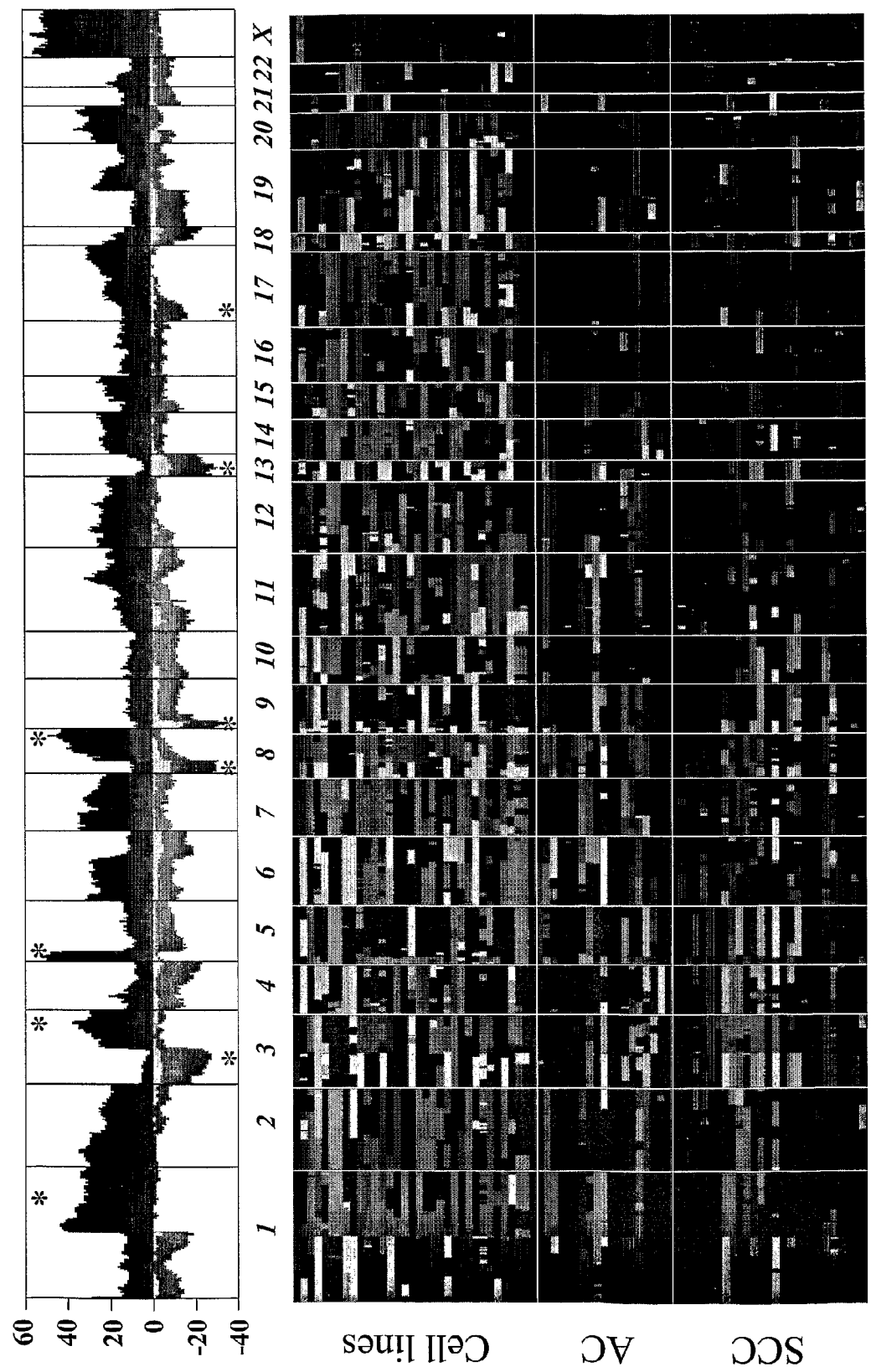
FIG. 1 depicts the genomic profiles of primary lung adeno- and squamous carcinomas and lung cancer cell lines. The upper panel shows the recurrence of chromosomal alterations. Integer-value recurrence of CNAs in segmented data (Y axis) is plotted for each probe evenly aligned along the X axis in chromosome order. Dark bars denote gain or loss of chromosome material, light bars represent probes within regions of amplification or deletion. Asterisks identify the most frequent region of gains and losses, as reported in the literature (Balsara, B. R., and Testa, J. R. (2002) *Oncogene* 21, 6877-6883). The lower panel shows a heat map plot showing discrete CNAs within all samples with the X axis representing probes ordered by genomic map positions and the Y axis representing individual samples. Light gray represents chromosomal gain/amplification and dark gray denotes chromosomal loss/deletion.

Table 1 contains markers of the invention which reside in MCRs of deletion and display decreased expression. Table 1 contains SEQ ID NOs: 1-67.

Table 2 contains markers of the invention which reside in MCRs of amplification and display increased expression. Table 2 contains SEQ ID NOs: 68-272.

Table 3 contains high-confident focal MCRs. Table 3 contains SEQ ID NOs: 273-340.

Table 4 contains a description of the cell lines provided herein.

Table 5 contains a description of the tumor samples provided herein.

Table 6 contains the oligonucleotide sequences provided herein. Table 6 contains SEQ ID NOs: 341-712.

Table 7 contains a list of high-confidence MCRs in lung adenocarcinoma (AC) and squamous cell carcinoma (SCC) primary tumors and cell lines. Table 7 contains SEQ ID NOs: 713-770.

Table 8 contains markers that are overexpressed in squamous cell carcinomas (SCCs) versus adenocarcinomas (ACs) and were overexpressed in the absence of gene copy number gains on 3q in SCCs. Table 8 contains SEQ ID NOs: 771-778.

Table 9 contains markers of the invention displaying increased expression in lung cancer primary tumors. Table 9 contains SEQ ID NOs: 779-848.

DETAILED DESCRIPTION OF THE INVENTION

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a novel cDNA or oligomer-based platform and bioinformatics tools which allowed for the high-resolution characterization of copy-number alterations in the lung cancer genome, e.g., the non-small cell lung cancer (NSCLC) genome (see Example 1).

To arrive at the identified loci and MCRs, array comparative genomic hybridization (array-CGH) was utilized to define copy number aberrations (CNAs) (gains and losses of chromosomal regions) in lung cancer cell lines and tumor specimens.

Segmentation analysis of the raw profiles to filter noise from the dataset (as described by Olshen and Venkatraman, Olshen, A. B., and Venkatraman, E. S. (2002) *ASA Proceedings of the Joint Statistical Meetings* 2530-2535; Ginzinger, D. G. (2002) *Exp Hematol* 30, 503-12; Golub, T. R., et al. (1999) *Science* 286, 531-7; Hyman, E., et al. (2002) *Cancer Res* 62, 6240-5; Lucito, R., et al. (2003) *Genome Res* 13, 2291-305) was performed and used to identify statistically significant changepoints in the data.

Identification of loci was based on an automated computer algorithm that utilized several basic criteria as follows: 1) segments above 0.4 or below −0.4 (0.5 and 0.55 for cDNA) are identified as altered; 2) if two or more altered segments are adjacent in a single profile or separated by less than 500 KB, the entire region spanned by the segments is considered to be an altered span; 3) highly altered segments or spans that are shorter than 20 MB are retained as "informative spans" for defining discrete locus boundaries. Longer regions are not discarded, but are not included in defining locus boundaries; 4) informative spans are compared across samples to identify overlapping groups of positive-value or negative-value segments; each group is called an "overlap group"; 5) overlap groups are divided into separate groups wherever the recurrence rate falls below 25% of the peak recurrence for the whole group; recurrence is calculated by counting the number of samples with alteration at high threshold (0.4, −0.4); and 6) minimal common regions (MCRs) are defined as contiguous spans having at least 75% of the peak recurrence. If two MCRs are separated by a gap of only one probe position, they are joined. If there are more than 3 MCRs in a locus, the whole region is reported as a single complex MCR.

A locus-identification algorithm was used that defines informative CNAs on the basis of size and achievement of a high significance threshold for the amplitude of change. Overlapping CNAs from multiple profiles were then merged in an automated fashion to define a discrete "locus" of regional copy number change, the bounds of which represent the combined physical extend to these overlapping CNAs. Each locus was characterized by a peak profile, the width and amplitude of which reflect the contour of the most prominent amplification or deletion for that locus. Furthermore, within each locus, one or more minimal common regions (MCRs) were identified across multiple tumor samples, with each MCR potentially harboring a distinct cancer-relevant gene targeted for copy number alteration across the sample set.

Figure 8:
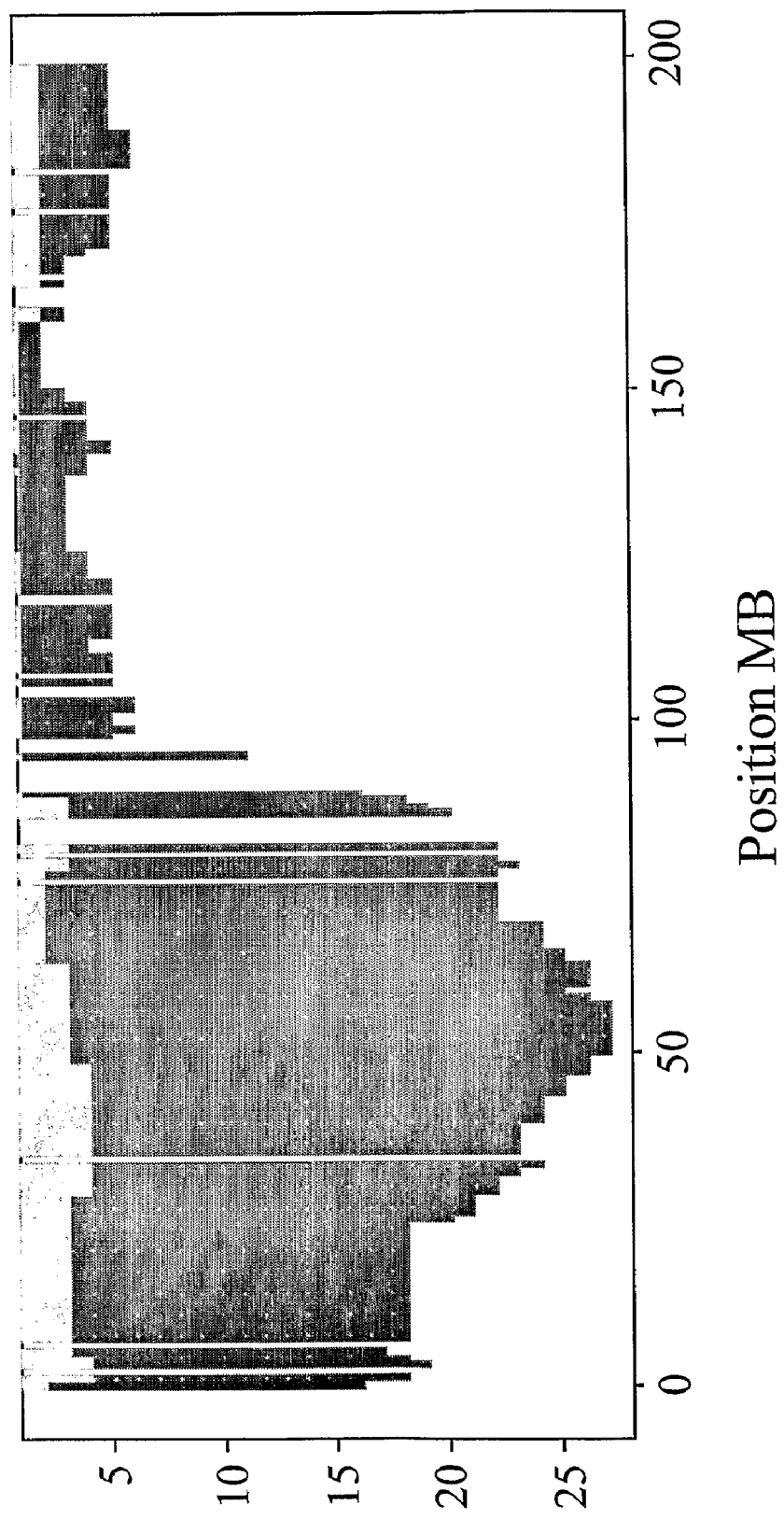
FIG. 8 depicts the recurrence of chromosome 3 alterations. Integer-value recurrence of CNAs in segmented data (Y axis) is plotted for each probe aligned along the X axis in chromosome order. Dark gray bars denote loss of chromosome material, light gray bars represent probes within regions of deletion (see the Materials and Methods section). White spaces represent gaps between probes.
Figure 9:
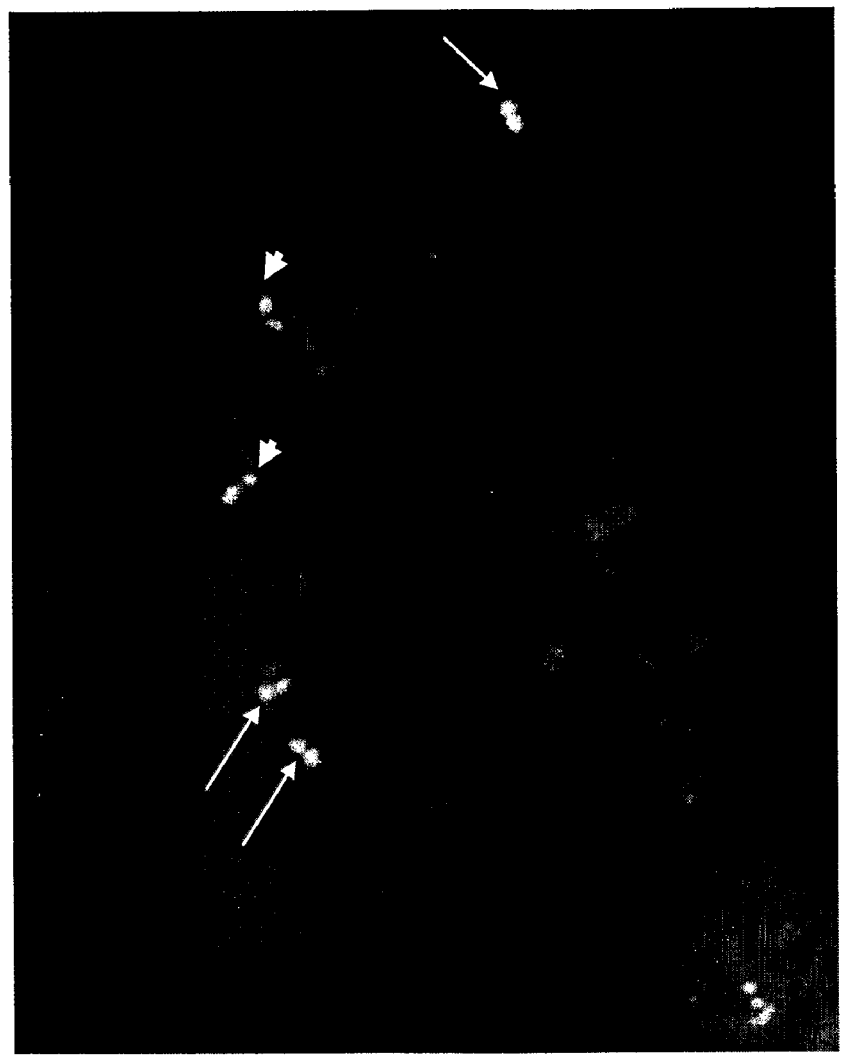
FIG. 9 depicts FISH analysis of the 8p12-p11.2 amplicon in the cell line NCI-H520. In addition to two normal copies of chromosome 8 (each showing single-probe labeling for BAC#2, light gray, and control BAC, dark red), three additional marker chromosomes showed signals for BAC#2 (light gray; arrows).
Figure 10:
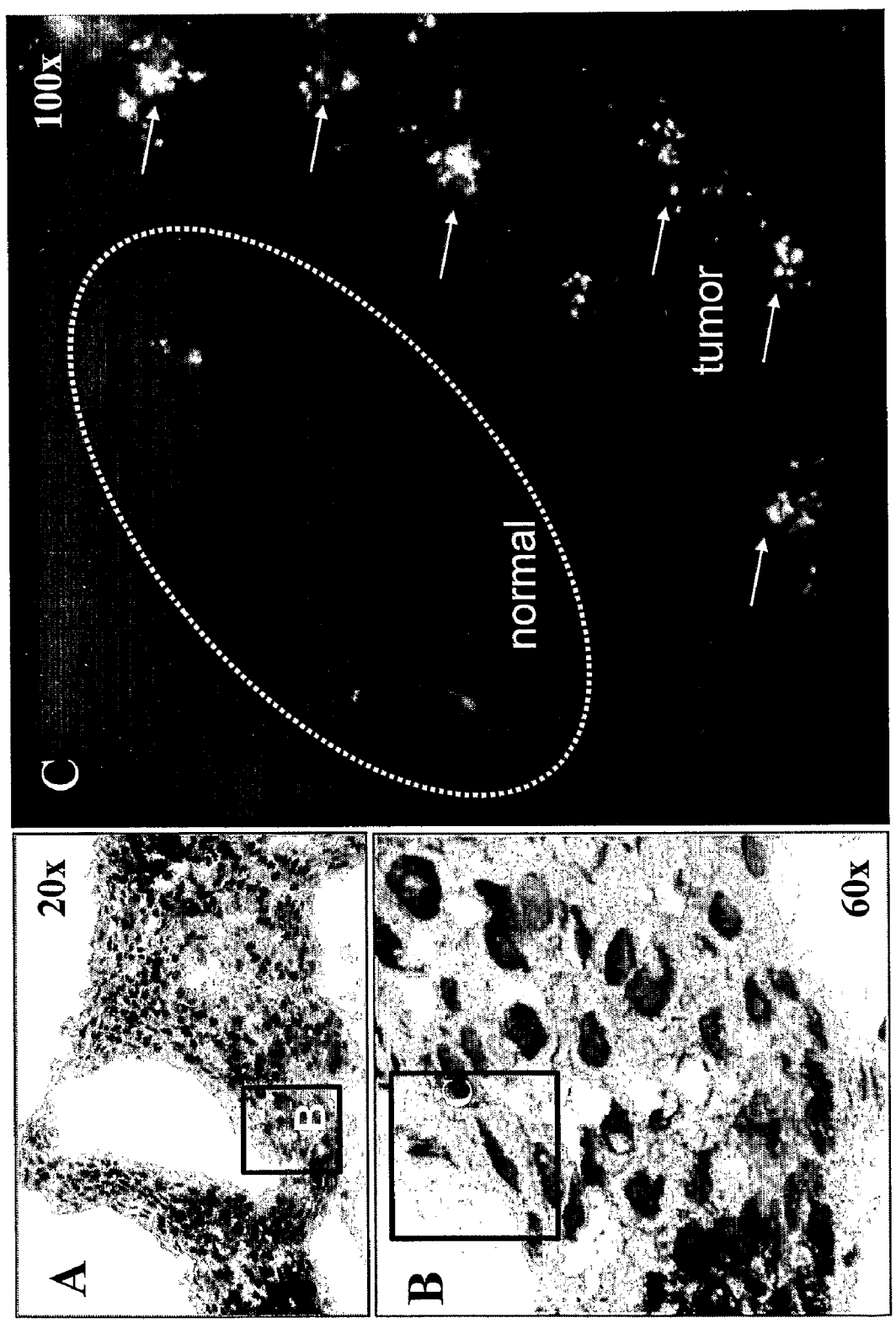
FIGS. 10A-10C depict FISH analysis of the 8p12-p11.2 amplicon in a tissue section from the primary tumor PT1, comparing adjacent tumor and normal tissues. In A, H&E stained slide showing normal and adjacent tumor at 20× magnification. B: 40× magnification. C: FISH of the region highlighted in B, including both normal tissue (inset, dotted line) and tumor tissue. High-level amplification is evident using the BAC#2 (light gray; arrows) in the tumor but not in the normal tissue (inset in the dotted line).
Figure 11:
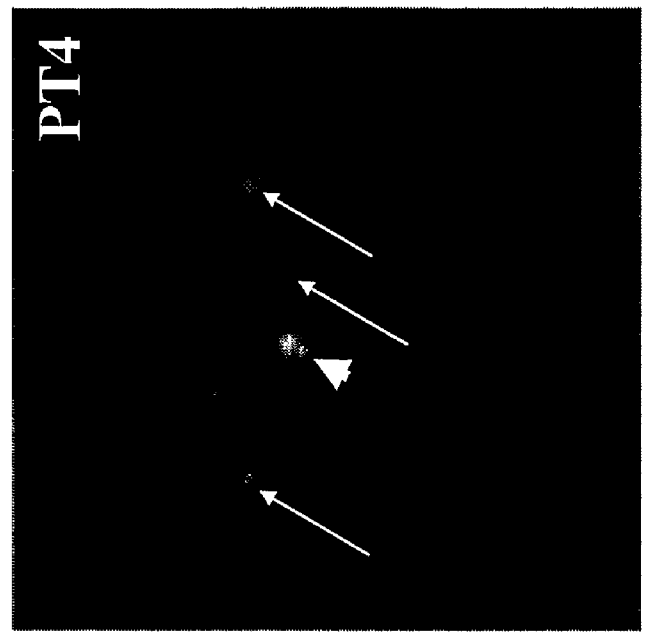
FIG. 11 depicts FISH analysis of the 8p12-p11.2 amplicon in a section from the primary tumor PT2 (left) and PT4 (right). Multiple high-intensity signals are evident when using the BAC#2 (dark gray; arrow) when compared with the control BAC (light gray; arrowhead).
Figure 11:
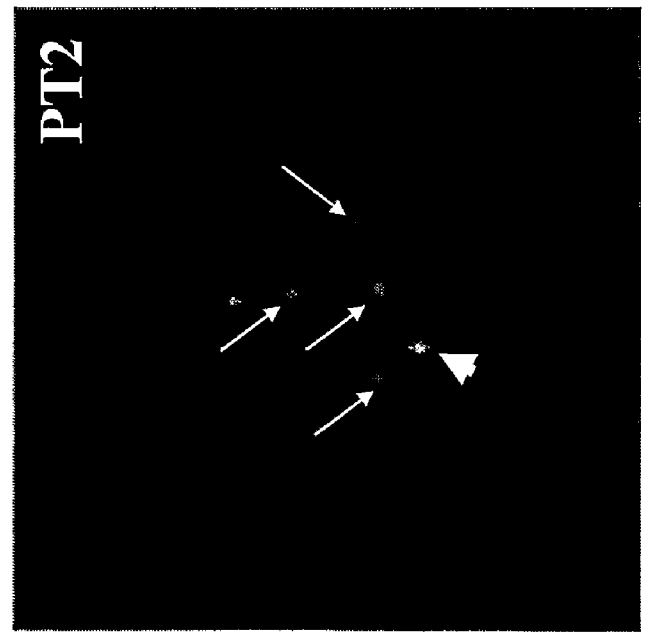

The locus-identification algorithm defined discrete MCRs within the dataset which were annotated in terms of recurrence, amplitude of change and representation in both cell lines and primary tumors. These discrete MCRs were prioritized based on four criteria that emphasize recurrent high-threshold changes in both primary tumors and cell lines (see Example 1). Implementation of this prioritization scheme yielded 126 MCRs of the present invention that satisfied at least three of the four criteria (see Tables 3 and 7; Table 7 shows high-confidence MCRs; Table 3 shows high-confidence focal MCRs) in lung adenocarcinoma and squamous cell carcinoma primary tumors and cell lines. The numbers of primary tumors (T) or cell lines (C) with gain or loss, and amplification or deletion, are listed, respectively. MCR recurrence is denoted as a percentage of the total dataset. In bold are the MCRs verified by RT-PCR and FISH. The short arm of chromosome 3 was consistently lost across several primary tumors and cell lines (FIG. 1 and FIG. 8). Three smaller regions within the short arm of chromosome 3 were identified by the automated locus definition program, based on the presence and recurrence of deletions in a subset of samples (FIG. 8, bright green bars).

The confidence-level ascribed to these prioritized loci was further validated by real-time quantitative PCR (QPCR), which demonstrated 100% concordance with 17 selected MCRs defined by array-CGH.

The MCRs identified herein possess a median size of 1.42 Mb, with 29 (23%) MCRs spanning 0.5 Mb or less, and possess an average of 4 annotated genes.

Also in Tables 3 and 7, the loci and MCRs are indicated as having either "gain and amplification" or "loss and deletion," indicating that each locus and MCR has either (1) increased copy number and/or expression or (2) decreased copy number and/or expression, or deletion.

Complementary expression profile analysis of a significant fraction of the genes residing within the MCRs of the present invention provided a subset of markers with statistically significant association between gene dosage and mRNA expression. Table 1 lists the markers of the invention which reside in MCRs of deletion and which consequently display decreased expression by comparison across lung cancer cell lines. Table 2 lists the markers of the invention which reside in MCRs of amplification that are overexpressed by comparison, across lung cancer cell lines. Additional markers within the MCRs that have not yet been annotated may also be used as markers for cancer as described herein, and are included in the invention.

The novel methods for identifying chromosomal regions of altered copy number, as described herein, may be applied to various data sets for various diseases, including, but not limited to, cancer. Other methods may be used to determine copy number aberrations as are known in the art, including, but not limited to oligonucleotide-based microarrays (Brennan, et al. (2004) *In Press*; Lucito, et al (2003) *Genome Res.* 13:2291-2305; Bignell et al. (2004) *Genome Res.* 14:287-295; Zhao, et al (2004) *Cancer Research*, 64(9):3060-71), and other methods as described herein including, for example, hybridization methods (such as, for example, FISH and FISH plus spectral karyotype (SKY)).

The amplification or deletion of the MCRs identified herein correlate with the presence of cancer, e.g., lung cancer and other epithelial cancers. Furthermore, analysis of copy number and/or expression levels of the genes residing within each MCR has led to the identification of individual markers and combinations of markers described herein, the increased and decreased expression and/or increased and decreased copy number of which correlate with the presence of cancer, e.g., lung cancer, e.g., NSCLC in a subject.

Accordingly, methods are provided herein for detecting the presence of cancer in a sample, the absence of cancer in a sample, and other characteristics of cancer that are relevant to prevention, diagnosis, characterization, and therapy of cancer in a subject by evaluating alterations in the amount, structure, and/or activity of a marker. For example, evaluation of the presence, absence or copy number of the MCRs identified herein, or by evaluating the copy number, expression level, protein level, protein activity, presence of mutations (e.g., substitution, deletion, or addition mutations) which affect activity of the marker, or methylation status of any one or more of the markers within the MCRs (e.g., the markers set forth in Tables 1 and 2), is within the scope of the invention.

Methods are also provided herein for the identification of compounds which are capable of inhibiting cancer, in a subject, and for the treatment, prevention, and/or inhibition of cancer using a modulator, e.g., an agonist or antagonist, of a gene or protein marker of the invention.

Although the MCRs and markers described herein were identified in lung cancer samples, the methods of the invention are in no way limited to use for the prevention, diagnosis, characterization, therapy and prevention of lung cancer, e.g., the methods of the invention may be applied to any cancer, as described herein.

Various aspects of the invention are described in further detail in the following subsections:

I. DEFINITIONS

As used herein, each of the following terms has the meaning associated with it in this section.

The articles "a" and "an" are used herein to refer to one or to more than one (i.e. to at least one) of the grammatical object of the article. By way of example, "an element" means one element or more than one element.

The terms "tumor" or "cancer" refer to the presence of cells possessing characteristics typical of cancer-causing cells, such as uncontrolled proliferation, immortality, metastatic potential, rapid growth and proliferation rate, and certain characteristic morphological features. Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, lung cancer, e.g., non-small cell lung carcinoma (NSCLC), melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

The term "lung cancer" or "neoplasia" as used herein, includes non-small cell lung carcinoma (NSCLC) and small cell carcinoma. Lung cancer may be "metastatic" from another source (e.g., colon) or may be "primary" (a tumour of lung cell origin).

As used herein, the term "non-small cell lung carcinoma", "non-small cell lung cancer", or "NSCLC" is a lung cancer that comprises all lung carcinomas except small cell carcinoma, and is intended to include adenocarcinoma (AC) of the lung, large cell carcinoma, alveolar cell carcinoma, and squamous cell carcinoma (SCC).

A "minimal common region (MCR)," as used herein, refers to a contiguous chromosomal region which displays either gain and amplification (increased copy number) or loss and deletion (decreased copy number) in the genome of a cancer. An MCR includes at least one nucleic acid sequence which has increased or decreased copy number and which is associated with a cancer. The MCRs of the instant invention include, but are not limited to, those set forth in Tables 3 and 7.

A "marker" is a gene or protein which may be altered, wherein said alteration is associated with cancer. The alteration may be in amount, structure, and/or activity in a cancer tissue or cancer cell, as compared to its amount, structure, and/or activity, in a normal or healthy tissue or cell (e.g., a control), and is associated with a disease state, such as cancer. For example, a marker of the invention which is associated with cancer may have altered copy number, expression level, protein level, protein activity, or methylation status, in a cancer tissue or cancer cell as compared to a normal, healthy tissue or cell. Furthermore, a "marker" includes a molecule whose structure is altered, e.g., mutated (contains an allelic variant), e.g., differs from the wild type sequence at the nucleotide or amino acid level, e.g., by substitution, deletion, or addition, when present in a tissue or cell associated with a disease state, such as cancer.

The term "altered amount" of a marker or "altered level" of a marker refers to increased or decreased copy number of a marker or chromosomal region, e.g., MCR, and/or increased or decreased expression level of a particular marker gene or genes in a cancer sample, as compared to the expression level or copy number of the marker in a control sample. The term "altered amount" of a marker also includes an increased or decreased protein level of a marker in a sample, e.g., a cancer sample, as compared to the protein level of the marker in a normal, control sample. Furthermore, an altered amount of a marker may be determined by detecting the methylation status of a marker, as described herein, which may affect the expression or activity of a marker.

The amount of a marker, e.g., expression or copy number of a marker or MCR, or protein level of a marker, in a subject is "significantly" higher or lower than the normal amount of a marker or MCR, if the amount of the marker is greater or less, respectively, than the normal level by an amount greater than the standard error of the assay employed to assess amount, and preferably at least twice, and more preferably three, four, five, ten or more times that amount. Alternately, the amount of the marker or MCR in the subject can be considered "significantly" higher or lower than the normal amount if the amount is at least about two, and preferably at least about three, four, or five times, higher or lower, respectively, than the normal amount of the marker or MCR.

The "copy number of a gene" or the "copy number of a marker" refers to the number of DNA sequences in a cell encoding a particular gene product. Generally, for a given gene, a mammal has two copies of each gene. The copy number can be increased, however, by gene amplification or duplication, or reduced by deletion.

The "normal" copy number of a marker or MCR or "normal" level of expression of a marker is the level of expression, copy number of the marker, or copy number of the MCR, in a biological sample, e.g., a sample containing tissue, whole blood, serum, plasma, buccal scrape, saliva, cerebrospinal fluid, urine, stool, bronchoalveolar lavage, and lung tissue, from a subject, e.g., a human, not afflicted with cancer.

The term "altered level of expression" of a marker or MCR refers to an expression level or copy number of a marker in a test sample e.g., a sample derived from a patient suffering from cancer, that is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples. The altered level of expression is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples.

An "overexpression" or "significantly higher level of expression or copy number" of a marker or MCR refers to an expression level or copy number in a test sample that is greater than the standard error of the assay employed to assess expression or copy number, and is preferably at least twice, and more preferably three, four, five or ten or more times the expression level or copy number of the marker or MCR in a control sample (e.g., sample from a healthy subject not afflicted with cancer) and preferably, the average expression level or copy number of the marker or MCR in several control samples.

An "underexpression" or "significantly lower level of expression or copy number" of a marker or MCR refers to an expression level or copy number in a test sample that is greater than the standard error of the assay employed to assess expression or copy number, but is preferably at least twice, and more preferably three, four, five or ten or more times less than the expression level or copy number of the marker or MCR in a control sample (e.g., sample from a healthy subject not afflicted with cancer) and preferably, the average expression level or copy number of the marker or MCR in several control samples.

"Methylation status" of a marker refers to the methylation pattern, e.g., methylation of the promoter of the marker, and/or methylation levels of the marker. DNA methylation is a heritable, reversible and epigenetic change. Yet, DNA methylation has the potential to alter gene expression, which has developmental and genetic consequences. DNA methylation has been linked to cancer, as described in, for example, Laird, et al. (1994) *Human Molecular Genetics* 3:1487-1495 and Laird, P. (2003) *Nature* 3:253-266, the contents of which are incorporated herein by reference. For example, methylation of CpG oligonucleotides in the promoters of tumor suppressor genes can lead to their inactivation. In addition, alterations in the normal methylation process are associated with genomic instability (Lengauer. et al. *Proc. Natl. Acad. Sci. USA* 94:2545-2550, 1997). Such abnormal epigenetic changes may be found in many types of cancer and can, therefore, serve as potential markers for oncogenic transformation.

Methods for determining methylation include restriction landmark genomic scanning (Kawai, et al., *Mol. Cell. Biol.* 14:7421-7427, 1994), methylation-sensitive arbitrarily primed PCR (Gonzalgo, et al., *Cancer Res.* 57:594-599, 1997); digestion of genomic DNA with methylation-sensitive restriction enzymes followed by Southern analysis of the regions of interest (digestion-Southern method); PCR-based process that involves digestion of genomic DNA with methylation-sensitive restriction enzymes prior to PCR amplification (Singer-Sam, et al., *Nucl. Acids Res.* 18:687, 1990); genomic sequencing using bisulfite treatment (Frommer, et al., *Proc. Natl. Acad. Sci. USA* 89:1827-1831, 1992); methylation-specific PCR (NSP) (Herman, et al. *Proc. Natl. Acad. Sci. USA* 93:9821-9826, 1992); and restriction enzyme digestion of PCR products amplified from bisulfite-converted DNA (Sadri and Hornsby, *Nucl. Acids Res.* 24:5058-5059, 1996; and Xiong and Laird, *Nucl. Acids. Res.* 25:2532-2534, 1997); PCR techniques for detection of gene mutations (Kuppuswamy, et al., *Proc. Natl. Acad. Sci. USA* 88:1143-1147, 1991) and quantitation of allelic-specific expression (Szabo and Mann, *Genes Dev.* 9:3097-3108, 1995; and Singer-Sam, et al., *PCR Methods Appl.* 1:160-163, 1992); and methods described in U.S. Pat. No. 6,251,594, the contents of which are incorporated herein by reference. An integrated genomic and epigenomic analysis as described in Zardo, et al. (2000) *Nature Genetics* 32:453-458, may also be used.

The term "altered activity" of a marker refers to an activity of a marker which is increased or decreased in a disease state, e.g., in a cancer sample, as compared to the activity of the marker in a normal, control sample. Altered activity of a marker may be the result of, for example, altered expression of the marker, altered protein level of the marker, altered structure of the marker, or, e.g., an altered interaction with other proteins involved in the same or different pathway as the marker or altered interaction with transcriptional activators or inhibitors, or altered methylation status.

The term "altered structure" of a marker refers to the presence of mutations or allelic variants within the marker gene or maker protein, e.g., mutations which affect expression or activity of the marker, as compared to the normal or wild-type gene or protein. For example, mutations include, but are not limited to substitutions, deletions, or addition mutations. Mutations may be present in the coding or non-coding region of the marker.

A "marker nucleic acid" is a nucleic acid (e.g., DNA, mRNA, cDNA) encoded by or corresponding to a marker of the invention. For example, such marker nucleic acid molecules include DNA (e.g., cDNA) comprising the entire or a partial sequence of any of the nucleic acid sequences set forth in Tables 1 or 2 or the complement or hybridizing fragment of such a sequence. The marker nucleic acid molecules also include RNA comprising the entire or a partial sequence of any of the nucleic acid sequences set forth in Tables 1 or 2 or the complement of such a sequence, wherein all thymidine residues are replaced with uridine residues. A "marker protein" is a protein encoded by or corresponding to a marker of the invention. A marker protein comprises the entire or a partial sequence of a protein encoded by any of the sequences set forth in Tables 1 or 2 or a fragment thereof. The terms "protein" and "polypeptide" are used interchangeably herein.

A "marker," as used herein, includes any nucleic acid sequence present in an MCR as set forth in Tables 3 and/or 7, or a protein encoded by such a sequence.

Markers identified herein include diagnostic and therapeutic markers. A single marker may be a diagnostic marker, a therapeutic marker, or both a diagnostic and therapeutic marker.

As used herein, the term "therapeutic marker" includes markers, e.g., markers set forth in Tables 1 and 2, which are believed to be involved in the development (including maintenance, progression, angiogenesis, and/or metastasis) of cancer. The cancer-related functions of a therapeutic marker may be confirmed by, e.g., (1) increased or decreased copy number (by, e.g., fluorescence in situ hybridization (FISH), and FISH plus spectral karotype (SKY), or quantitative PCR (qPCR)) or mutation (e.g., by sequencing), overexpression or underexpression (e.g., by in situ hybridization (ISH), Northern Blot, or qPCR), increased or decreased protein levels (e.g., by immunohistochemistry (IHC)), or increased or decreased protein activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) the inhibition of cancer cell proliferation and growth, e.g., in soft agar, by, e.g., RNA interference ("RNAi") of the marker; (3) the ability of the marker to enhance transformation of mouse embryo fibroblasts (MEFs) by oncogenes, e.g., Myc and RAS, or by RAS alone; (4) the ability of the marker to enhance or decrease the growth of tumor cell lines, e.g., in soft agar; (5) the ability of the marker to transform primary mouse cells in SCID explant; and/or; (6) the prevention of maintenance or formation of tumors, e.g., tumors arising de novo in an animal or tumors derived from human cancer cell lines, by inhibiting or activating the marker. In one embodiment, a therapeutic marker may be used as a diagnostic marker.

As used herein, the term "diagnostic marker" includes markers, e.g., markers set forth in Tables 1 and 2, which are useful in the diagnosis of cancer, e.g., over- or under-activity emergence, expression, growth, remission, recurrence or resistance of tumors before, during or after therapy. The predictive functions of the marker may be confirmed by, e.g., (1) increased or decreased copy number (e.g., by FISH, FISH plus SKY, or qPCR), overexpression or underexpression (e.g., by ISH, Northern Blot, or qPCR), increased or decreased protein level (e.g., by IHC), or increased or decreased activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) its presence or absence in a biological sample, e.g., a sample containing tissue, whole blood, serum, plasma, buccal scrape, saliva, cerebrospinal fluid, urine, stool, bronchoalveolar lavage, and/or lung tissue from a subject, e.g. a human, afflicted with cancer; (3) its presence or absence in clinical subset of patients with cancer (e.g., those responding to a particular therapy or those developing resistance).

Diagnostic markers also include "surrogate markers," e.g., markers which are indirect markers of cancer progression.

The term "probe" refers to any molecule which is capable of selectively binding to a specifically intended target molecule, for example a marker of the invention. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic monomers.

As used herein, the term "promoter/regulatory sequence" means a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a spatially or temporally restricted manner.

An "RNA interfering agent" as used herein, is defined as any agent which interferes with or inhibits expression of a target gene, e.g., a marker of the invention, by RNA interference (RNAi). Such RNA interfering agents include, but are not limited to, nucleic acid molecules including RNA molecules which are homologous to the target gene, e.g., a marker of the invention, or a fragment thereof, short interfering RNA (siRNA), and small molecules which interfere with or inhibit expression of a target gene by RNA interference (RNAi).

"RNA interference (RNAi)" is an evolutionarily conserved process whereby the expression or introduction of RNA of a sequence that is identical or highly similar to a target gene results in the sequence specific degradation or specific post-transcriptional gene silencing (PTGS) of messenger RNA (mRNA) transcribed from that targeted gene (see Coburn, G. and Cullen, B. (2002) *J. of Virology* 76(18):9225), thereby inhibiting expression of the target gene. In one embodiment, the RNA is double stranded RNA (dsRNA). This process has been described in plants, invertebrates, and mammalian cells.

In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target genes. As used herein, "inhibition of target gene expression" or "inhibition of marker gene expression" includes any decrease in expression or protein activity or level of the target gene (e.g., a marker gene of the invention) or protein encoded by the target gene, e.g., a marker protein of the invention. The decrease may be of at least 30%, 40%, 50%, 60%, 70%, 80%, 90%, 95% or 99% or more as compared to the expression of a target gene or the activity or level of the protein encoded by a target gene which has not been targeted by an RNA interfering agent.

"Short interfering RNA" (siRNA), also referred to herein as "small interfering RNA" is defined as an agent which functions to inhibit expression of a target gene, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the over hang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* April; 9(4):493-501 incorporated be reference herein).

RNA interfering agents, e.g., siRNA molecules, may be administered to a patient having or at risk for having cancer, to inhibit expression of a marker gene of the invention, e.g., a marker gene which is overexpressed in cancer (such as the markers listed in Table 2) and thereby treat, prevent, or inhibit cancer in the subject.

A "constitutive" promoter is a nucleotide sequence which, when operably linked with a polynucleotide which encodes or specifies a gene product, causes the gene product to be produced in a living human cell under most or all physiological conditions of the cell.

An "inducible" promoter is a nucleotide sequence which, when operably linked with a polynucleotide which encodes or specifies a gene product, causes the gene product to be produced in a living human cell substantially only when an inducer which corresponds to the promoter is present in the cell.

A "tissue-specific" promoter is a nucleotide sequence which, when operably linked with a polynucleotide which encodes or specifies a gene product, causes the gene product to be produced in a living human cell substantially only if the cell is a cell of the tissue type corresponding to the promoter.

A "transcribed polynucleotide" is a polynucleotide (e.g. an RNA, a cDNA, or an analog of one of an RNA or cDNA) which is complementary to or homologous with all or a portion of a mature RNA made by transcription of a marker of the invention and normal post-transcriptional processing (e.g. splicing), if any, of the transcript, and reverse transcription of the transcript.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "homology" or "identity," as used interchangeably herein, refer to sequence similarity between two polynucleotide sequences or between two polypeptide sequences, with identity being a more strict comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences. The term "substantial homology," as used herein, refers to homology of at least 50%, more preferably, 60%, 70%, 80%, 90%, 95% or more.

A marker is "fixed" to a substrate if it is covalently or non-covalently associated with the substrate such the substrate can be rinsed with a fluid (e.g. standard saline citrate, pH 7.4) without a substantial fraction of the marker dissociating from the substrate.

As used herein, a "naturally-occurring" nucleic acid molecule refers to an RNA or DNA molecule having a nucleotide sequence that occurs in nature (e.g. encodes a natural protein).

Cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

A kit is any manufacture (e.g. a package or container) comprising at least one reagent, e.g. a probe, for specifically detecting a marker of the invention, the manufacture being promoted, distributed, or sold as a unit for performing the methods of the present invention.

II. USES OF THE INVENTION

The present invention is based, in part, on the identification of chromosomal regions (MCRs) which are structurally altered leading to a different copy number in cancer cells as compared to normal (i.e. non-cancerous) cells. Furthermore, the present invention is based, in part, on the identification of markers, e.g., markers which reside in the MCRs of the invention, which have an altered amount, structure, and/or activity in cancer cells as compared to normal (i.e., non-cancerous) cells. The markers of the invention correspond to DNA, cDNA, RNA, and polypeptide molecules which can be detected in one or both of normal and cancerous cells.

The amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of one or more of these markers in a sample, e.g., a sample containing tissue, whole blood, serum, plasma, buccal scrape, saliva, cerebrospinal fluid, urine, stool, bronchoalveolar lavage, and lung tissue, is herein correlated with the cancerous state of the tissue. In addition, the presence, absence, and/or copy number of one or more of the MCRs of the invention in a sample is also correlated with the cancerous state of the tissue. The invention thus provides compositions, kits, and methods for assessing the cancerous state of cells (e.g. cells obtained from a non-human, cultured non-human cells, and in vivo cells) as well as methods for treatment, prevention, and/or inhibition of cancer using a modulator, e.g., an agonist or antagonist, of a marker of the invention.

The compositions, kits, and methods of the invention have the following uses, among others:

1) assessing whether a subject is afflicted with cancer;
2) assessing the stage of cancer in a human subject;
3) assessing the grade of cancer in a subject;
4) assessing the benign or malignant nature of cancer in a subject;
5) assessing the metastatic potential of cancer in a subject;
6) assessing the histological type of neoplasm associated with cancer in a subject;
7) making antibodies, antibody fragments or antibody derivatives that are useful for treating cancer and/or assessing whether a subject is afflicted with cancer;
8) assessing the presence of cancer cells;
9) assessing the efficacy of one or more test compounds for inhibiting cancer in a subject;
10) assessing the efficacy of a therapy for inhibiting cancer in a subject;
11) monitoring the progression of cancer in a subject;
12) selecting a composition or therapy for inhibiting cancer, e.g., in a subject;
13) treating a subject afflicted with cancer;

14) inhibiting cancer in a subject;

15) assessing the carcinogenic potential of a test compound; and 16) preventing the onset of cancer in a subject at risk for developing cancer.

The invention thus includes a method of assessing whether a subject is afflicted with cancer or is at risk for developing cancer. This method comprises comparing the amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of a marker in a subject sample with the normal level. A significant difference between the amount, structure, or activity of the marker in the subject sample and the normal level is an indication that the subject is afflicted with cancer. The invention also provides a method for assessing whether a subject is afflicted with cancer or is at risk for developing cancer by comparing the level of expression of marker(s) within an MCR or copy number of an MCR in a cancer sample with the level of expression of marker(s) within an MCR or copy number of an MCR in a normal, control sample. A significant difference between the level of expression of marker(s) within an MCR or copy number of the MCR in the subject sample and the normal level is an indication that the subject is afflicted with cancer. The MCR is selected from the group consisting of those listed in Tables 3 and/or 7.

The marker is selected from the group consisting of the markers listed in Tables 1 and 2. Table 1 lists markers which have a highly significant correlation between gene expression and gene dosage (p, 0.05). The level of expression or copy number of these markers is decreased in samples histologically identified as lung cancer, e.g., NSCLC. Table 1 also lists the chromosome, physical position, in Mb, and Locus ID No:, for each of the markers. Although one or more molecules corresponding to the markers listed in Table 1 may have been described by others, the significance of these markers with regard to the cancerous state of cells, has not previously been identified.

Table 2 also lists markers which have a highly significant correlation between gene expression and gene dosage (p, 0.05). The level of expression or copy number of these markers is increased in samples histologically identified as lung cancer, e.g., NSCLC. Table 2 also lists the chromosome, physical position, in Mb, and Locus ID No:, for each of the markers. Although one or more molecules corresponding to the markers listed in Table 2 may have been described by others, the significance of these markers with regard to the cancerous state of cells, has not previously been identified.

Any marker or combination of markers listed in Tables 1 or 2 or any MCR or combination of MCRs listed in Tables 3 and/or 7, may be used in the compositions, kits, and methods of the present invention. In general, it is preferable to use markers for which the difference between the amount, e.g., level of expression or copy number, and/or activity of the marker or MCR in cancer cells and the amount, e.g., level of expression or copy number, and/or activity of the same marker in normal cells, is as great as possible. Although this difference can be as small as the limit of detection of the method for assessing amount and/or activity of the marker, it is preferred that the difference be at least greater than the standard error of the assessment method, and preferably a difference of at least 2-, 3-, 4-, 5-, 6-, 7-, 8-, 9-, 10-, 15-, 20-, 25-, 100-, 500-, 1000-fold or greater than the amount, e.g., level of expression or copy number, and/or activity of the same biomarker in normal tissue.

It is understood that by routine screening of additional subject samples using one or more of the markers of the invention, it will be realized that certain of the markers have altered amount, structure, and/or activity in cancers of various types, including specific lung cancers, e.g., NSCLC, as well as other cancers, examples of which include, but are not limited to, melanomas, breast cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

For example, it will be confirmed that some of the markers of the invention have altered amount, structure, and/or activity in some, i.e., 10%, 20%, 30%, or 40%, or most (i.e. 50% or more) or substantially all (i.e. 80% or more) of cancer, e.g., lung cancer. Furthermore, it will be confirmed that certain of the markers of the invention are associated with cancer of various histologic subtypes.

In addition, as a greater number of subject samples are assessed for altered amount, structure, and/or activity of the markers or altered expression or copy number MCRs of the invention and the outcomes of the individual subjects from whom the samples were obtained are correlated, it will also be confirmed that markers have altered amount, structure, and/or activity of certain of the markers or altered expression or copy number of MCRs of the invention are strongly correlated with malignant cancers and that altered expression of other markers of the invention are strongly correlated with benign tumors or premalignant states. The compositions, kits, and methods of the invention are thus useful for characterizing one or more of the stage, grade, histological type, and benign/premalignant/malignant nature of cancer in subjects.

When the compositions, kits, and methods of the invention are used for characterizing one or more of the stage, grade, histological type, and benign/premalignant/malignant nature of cancer, in a subject, it is preferred that the marker or MCR or panel of markers or MCRs of the invention be selected such that a positive result is obtained in at least about 20%, and preferably at least about 40%, 60%, or 80%, and more preferably, in substantially all, subjects afflicted with cancer, of the corresponding stage, grade, histological type, or benign/premalignant/malignant nature. Preferably, the marker or panel of markers of the invention is selected such that a PPV (positive predictive value) of greater than about 10% is obtained for the general population (more preferably coupled with an assay specificity greater than 99.5%).

When a plurality of markers or MCRs of the invention are used in the compositions, kits, and methods of the invention, the amount, structure, and/or activity of each marker or level of expression or copy number can be compared with the normal amount, structure, and/or activity of each of the plurality of markers or level of expression or copy number, in non-cancerous samples of the same type, either in a single reaction mixture (i.e., using reagents, such as different fluorescent probes, for each marker) or in individual reaction mixtures corresponding to one or more of the markers or MCRs.

In one embodiment, a significantly altered amount, structure, and/or activity of more than one of the plurality of markers, or significantly altered copy number of one or more of the MCRs in the sample, relative to the corresponding normal levels, is an indication that the subject is afflicted with cancer. For example, a significantly lower copy number in the sample of each of the plurality of markers or MCRs, relative to the corresponding normal levels or copy number, is an indication that the subject is afflicted with cancer. In yet another embodiment, a significantly enhanced copy number of one or more markers or MCRs and a significantly lower level of expression or copy number of one or more markers or MCRs in a sample relative to the corresponding normal levels, is an indication that the subject is afflicted with cancer. Also, for example, a significantly enhanced copy number in the sample of each of the plurality of markers or MCRs, relative to the corresponding normal copy number, is an indication that the subject is afflicted with cancer. In yet another embodiment, a significantly enhanced copy number of one or more markers or MCRs and a significantly lower copy number of one or more markers or MCRs in a sample relative to the corresponding normal levels, is an indication that the subject is afflicted with cancer.

When a plurality of markers or MCRs are used, it is preferred that 2, 3, 4, 5, 8, 10, 12, 15, 20, 30, or 50 or more individual markers or MCRs be used or identified, wherein fewer markers or MCRs are preferred.

Only a small number of markers are known to be associated with, for example, lung cancer (e.g., MYC, $p16^{INK4A}$, RB1, RASSF1, TUSC2, SEMA3B, FHIT, and KRAS2). These markers or other markers which are known to be associated with other types of cancer may be used together with one or more markers of the invention in, for example, a panel of markers. In addition, frequent gains have been mapped to 1q31, 3q25-27, 5p13-14 and 8q23-24 and losses to 3p21, 8p22, 9p21-22, 13q22, and 17p12-13 (Bjorkqvist, A. M., et al. (1998) *Br J Cancer* 77, 260-9; Luk, C., et al. (2001) *Cancer Genet Cytogenet* 125, 87-99; Pei, J., et al. (2001) *Genes Chromosomes Cancer* 31, 282-7; Petersen, I., et al. (1997) *Cancer Res* 57, 2331-5; Balsara, B. R. & Testa, J. R. (2002) *Oncogene* 21, 6877-83) in lung cancer. In some instances, validated oncogenes and tumor suppressor genes residing within these loci have been identified, including MYC (8q24), $p16^{INK4A}$ (9p21), RB1 (13q14), RASSF1 (3p21), TUSC2 (3p21), SEMA3B (3p21), FHIT (3p14), and KRAS2 (12p12). It is well known that certain types of genes, such as oncogenes, tumor suppressor genes, growth factor-like genes, protease-like genes, and protein kinase-like genes are often involved with development of cancers of various types. Thus, among the markers of the invention, use of those which correspond to proteins which resemble known proteins encoded by known oncogenes and tumor suppressor genes, and those which correspond to proteins which resemble growth factors, proteases, and protein kinases, are preferred.

It is recognized that the compositions, kits, and methods of the invention will be of particular utility to subjects having an enhanced risk of developing cancer, and their medical advisors. Subjects recognized as having an enhanced risk of developing cancer, include, for example, subjects having a familial history of cancer, subjects identified as having a mutant oncogene (i.e. at least one allele), and subjects of advancing age.

An alteration, e.g. copy number, amount, structure, and/or activity of a marker in normal (i.e. non-cancerous) human tissue can be assessed in a variety of ways. In one embodiment, the normal level of expression or copy number is assessed by assessing the level of expression and/or copy number of the marker or MCR in a portion of cells which appear to be non-cancerous and by comparing this normal level of expression or copy number with the level of expression or copy number in a portion of the cells which are suspected of being cancerous. For example, when laparoscopy or other medical procedure, reveals the presence of a tumor on one portion of an organ, the normal level of expression or copy number of a marker or MCR may be assessed using the non-affected portion of the organ, and this normal level of expression or copy number may be compared with the level of expression or copy number of the same marker in an affected portion (i.e., the tumor) of the organ. Alternately, and particularly as further information becomes available as a result of routine performance of the methods described herein, population-average values for "normal" copy number, amount, structure, and/or activity of the markers or MCRs of the invention may be used. In other embodiments, the "normal" copy number, amount, structure, and/or activity of a marker or MCR may be determined by assessing copy number, amount, structure, and/or activity of the marker or MCR in a subject sample obtained from a non-cancer-afflicted subject, from a subject sample obtained from a subject before the suspected onset of cancer in the subject, from archived subject samples, and the like.

The invention includes compositions, kits, and methods for assessing the presence of cancer cells in a sample (e.g. an archived tissue sample or a sample obtained from a subject). These compositions, kits, and methods are substantially the same as those described above, except that, where necessary, the compositions, kits, and methods are adapted for use with certain types of samples. For example, when the sample is a parafinized, archived human tissue sample, it may be necessary to adjust the ratio of compounds in the compositions of the invention, in the kits of the invention, or the methods used. Such methods are well known in the art and within the skill of the ordinary artisan.

The invention thus includes a kit for assessing the presence of cancer cells (e.g. in a sample such as a subject sample). The kit may comprise one or more reagents capable of identifying a marker or MCR of the invention, e.g., binding specifically with a nucleic acid or polypeptide corresponding to a marker or MCR of the invention. Suitable reagents for binding with a polypeptide corresponding to a marker of the invention include antibodies, antibody derivatives, antibody fragments, and the like. Suitable reagents for binding with a nucleic acid (e.g. a genomic DNA, an mRNA, a spliced mRNA, a cDNA, or the like) include complementary nucleic acids. For example, the nucleic acid reagents may include oligonucleotides (labeled or non-labeled) fixed to a substrate, labeled oligonucleotides not bound with a substrate, pairs of PCR primers, molecular beacon probes, and the like.

The kit of the invention may optionally comprise additional components useful for performing the methods of the invention. By way of example, the kit may comprise fluids (e.g., SSC buffer) suitable for annealing complementary nucleic acids or for binding an antibody with a protein with which it specifically binds, one or more sample compartments, an instructional material which describes performance of a method of the invention, a sample of normal cells, a sample of cancer cells, and the like.

A kit of the invention may comprise a reagent useful for determining protein level or protein activity of a marker. In another embodiment, a kit of the invention may comprise a reagent for determining methylation status of a marker, or may comprise a reagent for determining alteration of structure of a marker, e.g., the presence of a mutation.

The invention also includes a method of making an isolated hybridoma which produces an antibody useful in methods and kits of the present invention. A protein corresponding to a marker of the invention may be isolated (e.g. by purification from a cell in which it is expressed or by transcription and translation of a nucleic acid encoding the protein in vivo or in vitro using known methods) and a vertebrate, preferably a mammal such as a mouse, rat, rabbit, or sheep, is immunized using the isolated protein. The vertebrate may optionally (and preferably) be immunized at least one additional time with the isolated protein, so that the vertebrate exhibits a robust immune response to the protein. Splenocytes are isolated from the immunized vertebrate and fused with an immortalized cell line to form hybridomas, using any of a variety of methods well known in the art. Hybridomas formed in this manner are then screened using standard methods to identify one or more hybridomas which produce an antibody which specifically binds with the protein. The invention also includes hybridomas made by this method and antibodies made using such hybridomas.

The invention also includes a method of assessing the efficacy of a test compound for inhibiting cancer cells. As described above, differences in the amount, structure, and/or activity of the markers of the invention, or level of expression or copy number of the MCRs of the invention, correlate with the cancerous state of cells. Although it is recognized that changes in the levels of amount, e.g., expression or copy number, structure, and/or activity of certain of the markers or expression or copy number of the MCRs of the invention likely result from the cancerous state of cells, it is likewise recognized that changes in the amount may induce, maintain, and promote the cancerous state. Thus, compounds which inhibit cancer, in a subject may cause a change, e.g., a change in expression and/or activity of one or more of the markers of the invention to a level nearer the normal level for that marker (e.g., the amount, e.g., expression, and/or activity for the marker in non-cancerous cells).

This method thus comprises comparing amount, e.g., expression, and/or activity of a marker in a first cell sample and maintained in the presence of the test compound and amount, e.g., expression, and/or activity of the marker in a second cell sample and maintained in the absence of the test compound. A significant increase in the amount, e.g., expression, and/or activity of a marker listed in Table 1 (e.g., a marker that was shown to be decreased in cancer), a significant decrease in the amount, e.g., expression, and/or activity of a marker listed in Table 2 (e.g., a marker that was shown to be increased in cancer), is an indication that the test compound inhibits cancer. The cell samples may, for example, be aliquots of a single sample of normal cells obtained from a subject, pooled samples of normal cells obtained from a subject, cells of a normal cell lines, aliquots of a single sample of cancer, cells obtained from a subject, pooled samples of cancer, cells obtained from a subject, cells of a cancer cell line, cells from an animal model of cancer, or the like. In one embodiment, the samples are cancer cells obtained from a subject and a plurality of compounds known to be effective for inhibiting various cancers, are tested in order to identify the compound which is likely to best inhibit the cancer in the subject.

This method may likewise be used to assess the efficacy of a therapy, e.g., chemotherapy, radiation therapy, surgery, or any other therapeutic approach useful for inhibiting cancer in a subject. In this method, the amount, e.g., expression, and/or activity of one or more markers of the invention in a pair of samples (one subjected to the therapy, the other not subjected to the therapy) is assessed. As with the method of assessing the efficacy of test compounds, if the therapy induces a significant decrease in the amount, e.g., expression, and/or activity of a marker listed in Table 2 (e.g., a marker that was shown to be increased in cancer), blocks induction of a marker listed in Table 2 (e.g., a marker that was shown to be increased in cancer), or if the therapy induces a significant enhancement of the amount, e.g., expression, and/or activity of a marker listed in Table 1 (e.g., a marker that was shown to be decreased in cancer), then the therapy is efficacious for inhibiting cancer. As above, if samples from a selected subject are used in this method, then alternative therapies can be assessed in vitro in order to select a therapy most likely to be efficacious for inhibiting cancer in the subject.

This method may likewise be used to monitor the progression of cancer in a subject, wherein if a sample in a subject has a significant decrease in the amount, e.g., expression, and/or activity of a marker listed in Table 2 (e.g., a marker that was shown to be increased in cancer, or blocks induction of a marker listed in Table 2 (e.g., a marker that was shown to be increased in cancer), or a significant enhancement of the amount, e.g., expression, and/or activity of a marker listed in Table 1 (e.g., a marker that was shown to be decreased in cancer), during the progression of cancer, e.g., at a first point in time and a subsequent point in time, then the cancer has improved. In yet another embodiment, between the first point in time and a subsequent point in time, the subject has undergone treatment, e.g., chemotherapy, radiation therapy, surgery, or any other therapeutic approach useful for inhibiting cancer, has completed treatment, or is in remission.

As described herein, cancer in subjects is associated with an increase in amount, e.g., expression, and/or activity of one or more markers listed in Table 2 (e.g., a marker that was shown to be increased in cancer), and/or a decrease in amount, e.g., expression, and/or activity of one or more markers listed in Table 1 (e.g., a marker that was shown to be decreased in cancer). While, as discussed above, some of these changes in amount, e.g., expression, and/or activity number result from occurrence of the cancer, others of these changes induce, maintain, and promote the cancerous state of cancer cells. Thus, cancer characterized by an increase in the amount, e.g., expression, and/or activity of one or more markers listed in Table 2 (e.g., a marker that was shown to be increased in cancer), can be inhibited by inhibiting amount, e.g., expression, and/or activity of those markers. Likewise, cancer characterized by a decrease in the amount, e.g., expression, and/or activity of one or more markers listed in Table 1 (e.g., a marker that was shown to be decreased in cancer), can be inhibited by enhancing amount, e.g., expression, and/or activity of those markers.

Amount and/or activity of a marker listed in Table 2 (e.g., a marker that was shown to be increased in cancer), can be inhibited in a number of ways generally known in the art. For example, an antisense oligonucleotide can be provided to the cancer cells in order to inhibit transcription, translation, or both, of the marker(s). An RNA interfering agent, e.g., an siRNA molecule, which is targeted to a marker listed in Table 2, can be provided to the cancer cells in order to inhibit expression of the target marker, e.g., through degradation or specific post-transcriptional gene silencing (PTGS) of the messenger RNA (mRNA) of the target marker. Alternately, a polynucleotide encoding an antibody, an antibody derivative, or an antibody fragment, e.g., a fragment capable of binding an antigen, and operably linked with an appropriate promoter or regulator region, can be provided to the cell in order to generate intracellular antibodies which will inhibit the function, amount, and/or activity of the protein corresponding to the marker(s). Conjugated antibodies or fragments thereof, e.g., chemolabeled antibodies, radiolabeled antibodies, or immunotoxins targeting a marker of the invention may also be administered to treat, prevent or inhibit cancer.

A small molecule may also be used to modulate, e.g., inhibit, expression and/or activity of a marker listed in Table 2. In one embodiment, a small molecule functions to disrupt a protein-protein interaction between a marker of the invention and a target molecule or ligand, thereby modulating, e.g., increasing or decreasing the activity of the marker.

Using the methods described herein, a variety of molecules, particularly including molecules sufficiently small that they are able to cross the cell membrane, can be screened in order to identify molecules which inhibit amount and/or activity of the marker(s). The compound so identified can be provided to the subject in order to inhibit amount and/or activity of the marker(s) in the cancer cells of the subject.

Amount and/or activity of a marker listed in Table 1 (e.g., a marker that was shown to be decreased in cancer), can be enhanced in a number of ways generally known in the art. For example, a polynucleotide encoding the marker and operably linked with an appropriate promoter/regulator region can be provided to cells of the subject in order to induce enhanced expression and/or activity of the protein (and mRNA) corresponding to the marker therein. Alternatively, if the protein is capable of crossing the cell membrane, inserting itself in the cell membrane, or is normally a secreted protein, then amount and/or activity of the protein can be enhanced by providing the protein (e.g. directly or by way of the bloodstream) to cancer cells in the subject. A small molecule may also be used to modulate, e.g., increase, expression or activity of a marker listed in Table 1. Furthermore, in another embodiment, a modulator of a marker of the invention, e.g., a small molecule, may be used, for example, to re-express a silenced gene, e.g., a tumor suppressor, in order to treat or prevent cancer. For example, such a modulator may interfere with a DNA binding element or a methyltransferase.

As described above, the cancerous state of human cells is correlated with changes in the amount and/or activity of the markers of the invention. Thus, compounds which induce increased expression or activity of one or more of the markers listed in Table 2 (e.g., a marker that was shown to be increased in cancer), decreased amount and/or activity of one or more of the markers listed in Table 1 (e.g., a marker that was shown to be decreased in cancer), can induce cell carcinogenesis. The invention also includes a method for assessing the human cell carcinogenic potential of a test compound. This method comprises maintaining separate aliquots of human cells in the presence and absence of the test compound. Expression or activity of a marker of the invention in each of the aliquots is compared. A significant increase in the amount and/or activity of a marker listed in Table 2 (e.g., a marker that was shown to be increased in cancer), or a significant decrease in the amount and/or activity of a marker listed in Table 1 (e.g., a marker that was shown to be decreased in cancer), in the aliquot maintained in the presence of the test compound (relative to the aliquot maintained in the absence of the test compound) is an indication that the test compound possesses human cell carcinogenic potential. The relative carcinogenic potentials of various test compounds can be assessed by comparing the degree of enhancement or inhibition of the amount and/or activity of the relevant markers, by comparing the number of markers for which the amount and/or activity is enhanced or inhibited, or by comparing both.

III. ISOLATED NUCLEIC ACID MOLECULES

One aspect of the invention pertains to isolated nucleic acid molecules that correspond to a marker of the invention, including nucleic acids which encode a polypeptide corresponding to a marker of the invention or a portion of such a polypeptide. The nucleic acid molecules of the invention include those nucleic acid molecules which reside in the MCRs identified herein. Isolated nucleic acid molecules of the invention also include nucleic acid molecules sufficient for use as hybridization probes to identify nucleic acid molecules that correspond to a marker of the invention, including nucleic acid molecules which encode a polypeptide corresponding to a marker of the invention, and fragments of such nucleic acid molecules, e.g., those suitable for use as PCR primers for the amplification or mutation of nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A nucleic acid molecule of the present invention, e.g., a nucleic acid molecules encoding a protein corresponding to a marker listed in Tables 1 or 2, can be isolated using standard molecular biology techniques and the sequence information in the database records described herein. Using all or a portion of such nucleic acid sequences, nucleic acid molecules of the invention can be isolated using standard hybridization and cloning techniques (e.g., as described in Sambrook et al., ed., *Molecular Cloning: A Laboratory Manual,* 2nd ed., Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which has a nucleotide sequence complementary to the nucleotide sequence of a nucleic acid corresponding to a marker of the invention or to the nucleotide sequence of a nucleic acid encoding a protein which corresponds to a marker of the invention. A nucleic acid molecule which is complementary to a given nucleotide sequence is one which is sufficiently complementary to the given nucleotide sequence that it can hybridize to the given nucleotide sequence thereby forming a stable duplex.

Moreover, a nucleic acid molecule of the invention call comprise only a portion of a nucleic acid sequence, wherein the full length nucleic acid sequence comprises a marker of the invention or which encodes a polypeptide corresponding to a marker of the invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more markers of the invention. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

The invention further encompasses nucleic acid molecules that differ, due to degeneracy of the genetic code, from the nucleotide sequence of nucleic acid molecules encoding a protein which corresponds to a marker of the invention, and thus encode the same protein.

In addition to the nucleotide sequences described in Tables 1 or 2, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

The term "allele," which is used interchangeably herein with "allelic variant," refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene or allele. Alleles of a specific gene, including, but not limited to, the genes listed in Tables 1, 2, or 3, can differ from each other in a single nucleotide, or several nucleotides, and can include substitutions, deletions, and insertions of nucleotides. An allele of a gene can also be a form of a gene containing one or more mutations.

The term "allelic variant of a polymorphic region of gene" or "allelic variant", used interchangeably herein, refers to an alternative form of a gene having one of several possible nucleotide sequences found in that region of the gene in the population. As used herein, allelic variant is meant to encompass functional allelic variants, non-functional allelic variants, SNPs, mutations and polymorphisms.

The term "single nucleotide polymorphism" (SNP) refers to a polymorphic site occupied by a single nucleotide, which is the site of variation between allelic sequences. The site is usually preceded by and followed by highly conserved sequences of the allele (e.g., sequences that vary in less than 1/100 or 1/1000 members of a population). A SNP usually arises due to substitution of one nucleotide for another at the polymorphic site. SNPs can also arise from a deletion of a nucleotide or an insertion of a nucleotide relative to a reference allele. Typically the polymorphic site is occupied by a base other than the reference base. For example, where the reference allele contains the base "T" (thymidine) at the polymorphic site, the altered allele can contain a "C" (cytidine), "G" (guanine), or "A" (adenine) at the polymorphic site. SNP's may occur in protein-coding nucleic acid sequences, in which case they may give rise to a defective or otherwise variant protein, or genetic disease. Such a SNP may alter the coding sequence of the gene and therefore specify another amino acid (a "missense" SNP) or a SNP may introduce a stop codon (a "nonsense" SNP). When a SNP does not alter the amino acid sequence of a protein, the SNP is called "silent." SNP's may also occur in noncoding regions of the nucleotide sequence. This may result in defective protein expression, e.g., as a result of alternative spicing, or it may have no effect on the function of the protein.

As used herein, the terms "gene" and "recombinant gene" refer to nucleic acid molecules comprising an open reading frame encoding a polypeptide corresponding to a marker of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In another embodiment, an isolated nucleic acid molecule of the invention is at least 7, 15, 20, 25, 30, 40, 60, 80, 100, 150, 200, 250, 300, 350, 400, 450, 550, 650, 700, 800, 900, 1000, 1200, 1400, 1600, 1800, 2000, 2200, 2400, 2600, 2800, 3000, 3500, 4000, 4500, or more nucleotides in length and hybridizes under stringent conditions to a nucleic acid molecule corresponding to a marker of the invention or to a nucleic acid molecule encoding a protein corresponding to a marker of the invention. As used herein, the term "hybridizes under stringent conditions" is intended to describe conditions for hybridization and washing under which nucleotide sequences at least 60% (65%, 70%, 75%, 80%, preferably 85%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a polypeptide of the invention that contain changes in amino acid residues that are not essential for activity. Such polypeptides differ in amino acid sequence from the naturally-occurring proteins which correspond to the markers of the invention, yet retain biological activity. In one embodiment, such a protein has an amino acid sequence that is at least about 40% identical, 50%, 60%, 70%, 80%, 90%, 95%, or 98% identical to the amino acid sequence of one of the proteins which correspond to the markers of the invention.

An isolated nucleic acid molecule encoding a variant protein can be created by introducing one or more nucleotide substitutions, additions or deletions into the nucleotide sequence of nucleic acids of the invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

The present invention encompasses antisense nucleic acid molecules, i.e., molecules which are complementary to a sense nucleic acid of the invention, e.g., complementary to the coding strand of a double-stranded cDNA molecule corresponding to a marker of the invention or complementary to an mRNA sequence corresponding to a marker of the invention. Accordingly, an antisense nucleic acid molecule of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a polypeptide corresponding to a selected marker of the invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the invention includes direct injection at a tissue site or infusion of the antisense nucleic acid into a lung-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which, contrary to the usual α-units, the strands run parallel to each other (Gaultier et al., 1987, *Nucleic Acids Res.* 15:6625-6641). The antisense nucleic acid molecule can also comprise a 2'-o-methylribonucleotide (Inoue et al., 1987, *Nucleic Acids Res.* 15:6131-6148) or a chimeric RNA-DNA analogue (Inoue et al., 1987, *FEBS Lett.* 215:327-330).

The invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach, 1988, *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the invention can be designed based upon the nucleotide sequence of a cDNA corresponding to the marker. For example, a derivative of a *Tetrahymena* L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the invention can be used to select a catalytic RNA having a specific ribonuclease activity from a pool of RNA molecules (see, e.g., Bartel and Szostak, 1993, *Science* 261:1411-1418).

The invention also encompasses nucleic acid molecules which form triple helical structures. For example, expression of a polypeptide of the invention can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al., 1989, *Nucleic Acids Res.* 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acid molecules having at least one region which is complementary to a nucleic acid molecule of the invention, such that the molecular beacon is useful for quantitating the presence of the nucleic acid molecule of the invention in a sample. A "molecular beacon" nucleic acid is a nucleic acid molecule comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid molecules are not annealed with one another, fluorescence of the fluorophore is quenched to a lesser degree. Molecular beacon nucleic acid molecules are described, for example, in U.S. Pat. No. 5,876,930.

IV. ISOLATED PROTEINS AND ANTIBODIES

One aspect of the invention pertains to isolated proteins which correspond to individual markers of the invention, and biologically active portions thereof, as well as polypeptide fragments suitable for use as immunogens to raise antibodies directed against a polypeptide corresponding to a marker of the invention. In one embodiment, the native polypeptide corresponding to a marker can be isolated from cells or tissue sources by an appropriate purification scheme using standard protein purification techniques. In another embodiment, polypeptides corresponding to a marker of the invention are produced by recombinant DNA techniques. Alternative to recombinant expression, a polypeptide corresponding to a marker of the invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a polypeptide corresponding to a marker of the invention include polypeptides comprising amino acid sequences sufficiently identical to or derived from the amino acid sequence of the protein corresponding to the marker (e.g., the protein encoded by the nucleic acid molecules listed in Tables 1 or 2), which include fewer amino acids than the full length protein, and exhibit at least one activity of the corresponding full-length protein. Typically, biologically active portions comprise a domain or motif with at least one activity of the corresponding protein. A biologically active portion of a protein of the invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the invention.

Preferred polypeptides have an amino acid sequence of a protein encoded by a nucleic acid molecule listed in Tables 1 or 2. Other useful proteins are substantially identical (e.g., at least about 40%, preferably 50%, 60%, 70%, 80%, 90%, 95%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the invention. BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The invention also provides chimeric or fusion proteins corresponding to a marker of the invention. As used herein, a "chimeric protein" or "fusion protein" comprises all or part (preferably a biologically active part) of a polypeptide corresponding to a marker of the invention operably linked to a heterologous polypeptide (i.e., a polypeptide other than the polypeptide corresponding to the marker). Within the fusion protein, the term "operably linked" is intended to indicate that the polypeptide of the invention and the heterologous polypeptide are fused in-frame to each other. The heterologous polypeptide can be fused to the amino-terminus or the carboxyl-terminus of the polypeptide of the invention.

One useful fusion protein is a GST fusion protein in which a polypeptide corresponding to a marker of the invention is fused to the carboxyl terminus of GST sequences. Such fusion proteins can facilitate the purification of a recombinant polypeptide of the invention.

In another embodiment, the fusion protein contains a heterologous signal sequence at its amino terminus. For example, the native signal sequence of a polypeptide corresponding to a marker of the invention can be removed and replaced with a signal sequence from another protein. For example, the gp67 secretory sequence of the baculovirus envelope protein can be used as a heterologous signal sequence (Ausubel et al., ed., *Current Protocols in Molecular Biology*, John Wiley & Sons, NY, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a polypeptide corresponding to a marker of the invention is fused to sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a polypeptide of the invention. Inhibition of ligand/receptor interaction can be useful therapeutically, both for treating proliferative and differentiative disorders and for modulating (e.g. promoting or inhibiting) cell survival. Moreover, the immunoglobulin fusion proteins of the invention can be used as immunogens to produce antibodies directed against a polypeptide of the invention in a subject, to purify ligands and in screening assays to identify molecules which inhibit the interaction of receptors with ligands.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the polypeptides corresponding to individual markers of the invention. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a protein of the invention which function as either agonists (mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the invention from a degenerate oligonucleotide sequence. Methods for synthesizing degenerate oligonucleotides are known in the art (see, e.g., Narang, 1983, *Tetrahedron* 39:3; Itakura et al, 1984, *Annu. Rev. Biochem.* 53:323; Itakura et al., 1984, *Science* 198:1056; Ike et al., 1983 *Nucleic Acid Res.* 11:477).

In addition, libraries of fragments of the coding sequence of a polypeptide corresponding to a marker of the invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan, 1992, *Proc. Natl. Acad. Sci. USA* 89:7811-7815; Delgrave et al, 1993, *Protein Engineering* 6(3):327-331).

An isolated polypeptide corresponding to a marker of the invention, or a fragment thereof, can be used as an immunogen to generate antibodies using standard techniques for polyclonal and monoclonal antibody preparation. The full-length polypeptide or protein can be used or, alternatively, the invention provides antigenic peptide fragments for use as immunogens. The antigenic peptide of a protein of the invention comprises at least 8 (preferably 10, 15, 20, or 30 or more) amino acid residues of the amino acid sequence of one of the polypeptides of the invention, and encompasses an epitope of the protein such that an antibody raised against the peptide forms a specific immune complex with a marker of the invention to which the protein corresponds. Preferred epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions.

An immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect of the invention pertains to antibodies directed against a polypeptide of the invention. The terms "antibody" and "antibody substance" as used interchangeably herein refer to immunoglobulin molecules and immunologically active portions of immunoglobulin molecules, i.e., molecules that contain an antigen binding site which specifically binds an antigen, such as a polypeptide of the invention. A molecule which specifically binds to a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope.

Polyclonal antibodies can be prepared as described above by immunizing a suitable subject with a polypeptide of the invention as an immunogen. The antibody titer in the immunized subject can be monitored over time by standard techniques, such as with an enzyme linked immunosorbent assay (ELISA) using immobilized polypeptide. If desired, the antibody molecules can be harvested or isolated from the subject (e.g., from the blood or serum of the subject) and further purified by well-known techniques, such as protein A chromatography to obtain the IgG fraction. At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy*, Alan R. Liss, Inc., 1985) or trioma techniques. The technology for producing hybridomas is well known (see generally *Current Protocols in Immunology*, Coligan et al. ed., John Wiley & Sons, New York, 1994).

Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a polypeptide of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog No. 27-9400-01; and the Stratagene *SurfZAP Phage Display Kit*, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

Completely human antibodies are particularly desirable for therapeutic treatment of human subjects. Such antibodies can be produced using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide corresponding to a marker of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995) *Int. Rev. Immunol.* 13:65-93). For a detailed discussion of this technology for producing human antibodies and human monoclonal antibodies and protocols for producing such antibodies, see, e.g., U.S. Pat. No. 5,625,126; U.S. Pat. No. 5,633,425; U.S. Pat. No. 5,569,825; U.S. Pat. No. 5,661,016; and U.S. Pat. No. 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al., 1994, *Bio/technology* 12:899-903).

An antibody, antibody derivative, or fragment thereof, which specifically binds a marker of the invention which is overexpressed in cancer (e.g., a marker set forth in Table 2), may be used to inhibit activity of a marker, e.g., a marker set forth in Table 2, and therefore may be administered to a subject to treat, inhibit, or prevent cancer in the subject. Furthermore, conjugated antibodies may also be used to treat, inhibit, or prevent cancer in a subject. Conjugated antibodies, preferably monoclonal antibodies, or fragments thereof, are antibodies which are joined to drugs, toxins, or radioactive atoms, and used as delivery vehicles to deliver those substances directly to cancer cells. The antibody, e.g., an antibody which specifically binds a marker of the invention (e.g., a marker listed in Table 2), is administered to a subject and binds the marker, thereby delivering the toxic substance to the cancer cell, minimizing damage to normal cells in other parts of the body.

Conjugated antibodies are also referred to as "tagged," "labeled," or "loaded." Antibodies with chemotherapeutic agents attached are generally referred to as chemolabeled. Antibodies with radioactive particles attached are referred to as radiolabeled, and this type of therapy is known as radioimmunotherapy (RIT). Aside from being used to treat cancer, radiolabeled antibodies can also be used to detect areas of cancer spread in the body. Antibodies attached to toxins are called immunotoxins.

Immunotoxins are made by attaching toxins (e.g., poisonous substances from plants or bacteria) to monoclonal antibodies. Immunotoxins may be produced by attaching monoclonal antibodies to bacterial toxins such as diphtherial toxin (DT) or pseudomonal exotoxin (PE40), or to plant toxins such as ricin A or saporin.

An antibody directed against a polypeptide corresponding to a marker of the invention (e.g., a monoclonal antibody) can be used to isolate the polypeptide by standard techniques, such as affinity chromatography or immunoprecipitation. Moreover, such an antibody can be used to detect the marker (e.g., in a cellular lysate or cell supernatant) in order to evaluate the level and pattern of expression of the marker. The antibodies can also be used diagnostically to monitor protein levels in tissues or body fluids (e.g. in a lung-associated body fluid) as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

V. RECOMBINANT EXPRESSION VECTORS AND HOST CELLS

Another aspect of the invention pertains to vectors, preferably expression vectors, containing a nucleic acid encoding a polypeptide corresponding to a marker of the invention (or a portion of such a polypeptide). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, Calif. (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein.

The recombinant expression vectors of the invention can be designed for expression of a polypeptide corresponding to a marker of the invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in E. coli with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., 1988, *Gene* 69:301-315) and pET 11d (Studier et al., p. 60-89, In *Gene Expression Technology: Methods in Enzymology* vol. 185, Academic Press, San Diego, Calif., 1991). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21 (DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacterium with an impaired capacity to proteolytically cleave the recombinant protein (Gottesman, p. 119-128, In *Gene Expression Technology: Methods in Enzymology* vol. 185, Academic Press, San Diego, Calif., 1990. Another strategy is to alter the nucleic acid sequence of the nucleic acid to be inserted into an expression vector so that the individual codons for each amino acid are those preferentially utilized in *E. coli* (Wada et al., 1992, *Nucleic Acids Res.* 20:2111-2118). Such alteration of nucleic acid sequences of the invention can be carried out by standard DNA synthesis techniques.

In another embodiment, the expression vector is a yeast expression vector. Examples of vectors for expression in yeast *S. cerevisiae* include pYepSec1 (Baldari et al., 1987, *EMBO J.* 6:229-234), pMFa (Kurjan and Herskowitz, 1982, *Cell* 30:933-943), pJRY88 (Schultz et al., 1987, *Gene* 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells) include the pAc series (Smith et al., 1983, *Mol. Cell. Biol.* 3:2156-2165) and the pVL series (Lucklow and Summers, 1989, *Virology* 170:31-39).

In yet another embodiment, a nucleic acid of the invention is expressed in mammalian cells using a mammalian expression vector. Examples of mammalian expression vectors include pCDM8 (Seed, 1987, *Nature* 329:840) and pMT2PC (Kaufman et al, 1987, *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al, 1987, *Genes Dev.* 1:268-277), lymphoid-specific promoters (Calame and Eaton, 1988, *Adv. Immunol* 43:235-275), in particular promoters of T cell receptors (Winoto and Baltimore, 1989, *EMBO J.* 8:729-733) and immunoglobulins (Banerji et al., 1983, *Cell* 33:729-740; Queen and Baltimore, 1983, *Cell* 33:741-748), neuron-specific promoters (e.g., the neurofilament promoter; Byrne and Ruddle, 1989, *Proc. Natl. Acad. Sci. USA* 86:5473-5477), pancreas-specific promoters (Edlund et al, 1985, *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss, 1990, *Science* 249:374-379) and the α-fetoprotein promoter (Camper and Tilghman, 1989, *Genes Dev.* 3:537-546).

The invention further provides a recombinant expression vector comprising a DNA molecule of the invention cloned into the expression vector in an antisense orientation. That is, the DNA molecule is operably linked to a regulatory sequence in a manner which allows for expression (by transcription of the DNA molecule) of an RNA molecule which is antisense to the mRNA encoding a polypeptide of the invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes see Weintraub et al., 1986, *Trends in Genetics*, Vol. 1(1).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce a polypeptide corresponding to a marker of the invention. Accordingly, the invention further provides methods for producing a polypeptide corresponding to a marker of the invention using the host cells of the invention. In one embodiment, the method comprises culturing the host cell of invention (into which a recombinant expression vector encoding a polypeptide of the invention has been introduced) in a suitable medium such that the marker is produced. In another embodiment, the method further comprises isolating the marker polypeptide from the medium or the host cell.

The host cells of the invention can also be used to produce nonhuman transgenic animals. For example, in one embodiment, a host cell of the invention is a fertilized oocyte or an embryonic stem cell into which sequences encoding a polypeptide corresponding to a marker of the invention have been introduced. Such host cells can then be used to create non-human transgenic animals in which exogenous sequences encoding a marker protein of the invention have been introduced into their genome or homologous recombinant animals in which endogenous gene(s) encoding a polypeptide corresponding to a marker of the invention sequences have been altered. Such animals are useful for studying the function and/or activity of the polypeptide corresponding to the marker, for identifying and/or evaluating modulators of polypeptide activity, as well as in pre-clinical testing of therapeutics or diagnostic molecules, for marker discovery or evaluation, e.g., therapeutic and diagnostic marker discovery or evaluation, or as surrogates of drug efficacy and specificity.

As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, an "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal. Transgenic animals also include inducible transgenic animals, such as those described in, for example, Chan I. T., et al. (2004) *J Clin Invest.* 113(4):528-38 and Chin L. et al (1999) *Nature* 400 (6743):468-72.

A transgenic animal of the invention can be created by introducing a nucleic acid encoding a polypeptide corresponding to a marker of the invention into the male pronuclei of a fertilized oocyte, e.g., by microinjection, retroviral infection, and allowing the oocyte to develop in a pseudopregnant female foster animal. Intronic sequences and polyadenylation signals can also be included in the transgene to increase the efficiency of expression of the transgene. A tissue-specific regulatory sequence(s) can be operably linked to the transgene to direct expression of the polypeptide of the invention to particular cells. Methods for generating transgenic animals via embryo manipulation and microinjection, particularly animals such as mice, have become conventional in the art and are described, for example, in U.S. Pat. Nos. 4,736,866 and 4,870,009, U.S. Pat. No. 4,873,191 and in Hogan, *Manipulating the Mouse Embryo*, Cold Spring Harbor Laboratory Press, Cold Spring Harbor, N.Y., 1986. Similar methods are used for production of other transgenic animals. A transgenic founder animal can be identified based upon the presence of the transgene in its genome and/or expression of mRNA encoding the transgene in tissues or cells of the animals. A transgenic founder animal can then be used to breed additional animals carrying the transgene. Moreover, transgenic animals carrying the transgene can further be bred to other transgenic animals carrying other transgenes.

To create an homologous recombinant animal, a vector is prepared which contains at least a portion of a gene encoding a polypeptide corresponding to a marker of the invention into which a deletion, addition or substitution has been introduced to thereby alter, e.g., functionally disrupt, the gene. In a preferred embodiment, the vector is designed such that, upon homologous recombination, the endogenous gene is functionally disrupted (i.e., no longer encodes a functional protein; also referred to as a "knock out" vector). Alternatively, the vector can be designed such that, upon homologous recombination, the endogenous gene is mutated or otherwise altered but still encodes functional protein (e.g., the upstream regulatory region can be altered to thereby alter the expression of the endogenous protein). In the homologous recombination vector, the altered portion of the gene is flanked at its 5' and 3' ends by additional nucleic acid of the gene to allow for homologous recombination to occur between the exogenous gene carried by the vector and an endogenous gene in an embryonic stem cell. The additional flanking nucleic acid sequences are of sufficient length for successful homologous recombination with the endogenous gene. Typically, several kilobases of flanking DNA (both at the 5' and 3' ends) are included in the vector (see, e.g., Thomas and Capecchi, 1987, *Cell* 51:503 for a description of homologous recombination vectors). The vector is introduced into an embryonic stem cell line (e.g., by electroporation) and cells in which the introduced gene has homologously recombined with the endogenous gene are selected (see, e.g., Li et al., 1992, *Cell* 69:915). The selected cells are then injected into a blastocyst of an animal (e.g., a mouse) to form aggregation chimeras (see, e.g., Bradley, *Teratocarcinomas and Embryonic Stem Cells: A Practical Approach*, Robertson, Ed., IRL, Oxford, 1987, pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Bio/Technology* 2:823-829 and in PCT Publication NOS. WO 90/11354, WO 91/01140, WO 92/0968, and WO 93/04169.

In another embodiment, transgenic non-human animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al, 1991, *Science* 251:1351-1355). If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut et al. (1997) *Nature* 385:810-813 and PCT Publication NOS. WO 97/07668 and WO 97/07669.

VI. METHODS OF TREATMENT

The present invention provides for both prophylactic and therapeutic methods of treating a subject, e.g., a human, who has or is at risk of (or susceptible to) cancer, e.g., lung cancer, e.g., NSCLC. As used herein, "treatment" of a subject includes the application or administration of a therapeutic agent to a subject, or application or administration of a therapeutic agent to a cell or tissue from a subject, who has a diseases or disorder, has a symptom of a disease or disorder, or is at risk of (or susceptible to) a disease or disorder, with the purpose of curing, inhibiting, healing, alleviating, relieving, altering, remedying, ameliorating, improving, or affecting the disease or disorder, the symptom of the disease or disorder, or the risk of (or susceptibility to) the disease or disorder. As used herein, a "therapeutic agent" or "compound" includes, but is not limited to, small molecules, peptides, peptidomimetics, polypeptides, RNA interfering agents, e.g., siRNA molecules, antibodies, ribozymes, and antisense oligonucleotides.

As described herein, cancer in subjects is associated with a change, e.g., an increase in the amount and/or activity, or a change in the structure, of one or more markers listed in Table 2 (e.g., a marker that was shown to be increased in cancer), and/or a decrease in the amount and/or activity, or a change in the structure of one or more markers listed in Table 1 (e.g., a marker that was shown to be decreased in cancer). While, as discussed above, some of these changes in amount, structure, and/or activity, result from occurrence of the cancer, others of these changes induce, maintain, and promote the cancerous state of cancer, cells. Thus, cancer, characterized by an increase in the amount and/or activity, or a change in the structure, of one or more markers listed in Table 2 (e.g., a marker that is shown to be increased in cancer), can be inhibited by inhibiting amount, e.g., expression or protein level, and/or activity of those markers. Likewise, cancer characterized by a decrease in the amount and/or activity, or a change in the structure, of one or more markers listed in Table 1 (e.g., a marker that is shown to be decreased in cancer), can be inhibited by enhancing amount, e.g., expression or protein level, and/or activity of those markers Accordingly, another aspect of the invention pertains to methods for treating a subject suffering from cancer. These methods involve administering to a subject a compound which modulates amount and/or activity of one or more markers of the invention. For example, methods of treatment or prevention of cancer include administering to a subject a compound which decreases the amount and/or activity of one or more markers listed in Table 2 (e.g., a marker that was shown to be increased in cancer). Compounds, e.g., antagonists, which may be used to inhibit amount and/or activity of a marker listed in Table 2, to thereby treat or prevent cancer include antibodies (e.g., conjugated antibodies), small molecules, RNA interfering agents, e.g., siRNA molecules, ribozymes, and antisense oligonucleotides. In one embodiment, an antibody used for treatment is conjugated to a toxin, a chemotherapeutic agent, or radioactive particles.

Methods of treatment or prevention of cancer also include administering to a subject a compound which increases the amount and/or activity of one or more markers listed in Table 1 (e.g., a marker that was shown to be decreased in cancer). Compounds, e.g., agonists, which may be used to increase expression or activity of a marker listed in Table 1, to thereby treat or prevent cancer include small molecules, peptides, peptoids, peptidomimetics, and polypeptides.

Small molecules used in the methods of the invention include those which inhibit a protein-protein interaction and thereby either increase or decrease marker amount and/or activity. Furthermore, modulators, e.g., small molecules, which cause re-expression of silenced genes, e.g., tumor suppressors, are also included herein. For example, such molecules include compounds which interfere with DNA binding or methyltransferase activity.

An aptamer may also be used to modulate, e.g., increase or inhibit expression or activity of a marker of the invention to thereby treat, prevent or inhibit cancer. Aptamers are DNA or RNA molecules that have been selected from random pools based on their ability to bind other molecules. Aptamers may be selected which bind nucleic acids or proteins.

VII. SCREENING ASSAYS

The invention also provides methods (also referred to herein as "screening assays") for identifying modulators, i.e., candidate or test compounds or agents (e.g., proteins, peptides, peptidomimetics, peptoids, small molecules or other drugs) which (a) bind to a marker of the invention, or (b) have a modulatory (e.g., stimulatory or inhibitory) effect on the activity of a marker of the invention or, more specifically, (c) have a modulatory effect on the interactions of a marker of the invention with one or more of its natural substrates (e.g., peptide, protein, hormone, co-factor, or nucleic acid), or (d) have a modulatory effect on the expression of a marker of the invention. Such assays typically comprise a reaction between the marker and one or more assay components. The other components may be either the test compound itself, or a combination of test compound and a natural binding partner of the marker. Compounds identified via assays such as those described herein may be useful, for example, for modulating, e.g., inhibiting, ameliorating, treating, or preventing cancer.

The test compounds of the present invention may be obtained from any available source, including systematic libraries of natural and/or synthetic compounds. Test compounds may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla et al, 1990, *Proc. Natl. Acad. Sci.* 87:6378-6382; Felici, 1991, *J. Mol. Biol.* 222:301-310; Ladner, supra.).

In one embodiment, the invention provides assays for screening candidate or test compounds which are substrates of a marker of the invention or biologically active portion thereof. In another embodiment, the invention provides assays for screening candidate or test compounds which bind to a marker of the invention or biologically active portion thereof. Determining the ability of the test compound to directly bind to a marker can be accomplished, for example, by coupling the compound with a radioisotope or enzymatic label such that binding of the compound to the marker can be determined by detecting the labeled marker compound in a complex. For example, compounds (e.g., marker substrates) can be labeled with $^{125}I$, $^{35}S$, $^{14}C$, or $^{3}H$, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

In another embodiment, the invention provides assays for screening candidate or test compounds which modulate the activity of a marker of the invention or a biologically active portion thereof. In all likelihood, the marker can, in vivo, interact with one or more molecules, such as, but not limited to, peptides, proteins, hormones, cofactors and nucleic acids. For the purposes of this discussion, such cellular and extracellular molecules are referred to herein as "binding partners" or marker "substrate".

One necessary embodiment of the invention in order to facilitate such screening is the use of the marker to identify its natural in vivo binding partners. There are many ways to accomplish this which are known to one skilled in the art. One example is the use of the marker protein as "bait protein" in a two-hybrid assay or three-hybrid assay (see, e.g., U.S. Pat. No. 5,283,317; Zervos et al, 1993, *Cell* 72:223-232; Madura et al, 1993, *J. Biol. Chem.* 268:12046-12054; Bartel et al, 1993, *Biotechniques* 14:920-924; Iwabuchi et al, 1993 *Oncogene* 8:1693-1696; Brent WO94/10300) in order to identify other proteins which bind to or interact with the marker (binding partners) and, therefore, are possibly involved in the natural function of the marker. Such marker binding partners are also likely to be involved in the propagation of signals by the marker or downstream elements of a marker-mediated signaling pathway. Alternatively, such marker binding partners may also be found to be inhibitors of the marker.

The two-hybrid system is based on the modular nature of most transcription factors, which consist of separable DNA-binding and activation domains. Briefly, the assay utilizes two different DNA constructs. In one construct, the gene that encodes a marker protein fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a marker-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be readily detected and cell colonies containing the functional transcription factor can be isolated and used to obtain the cloned gene which encodes the protein which interacts with the marker protein.

In a further embodiment, assays may be devised through the use of the invention for the purpose of identifying compounds which modulate (e.g., affect either positively or negatively) interactions between a marker and its substrates and/or binding partners. Such compounds can include, but are not limited to, molecules such as antibodies, peptides, hormones, oligonucleotides, nucleic acids, and analogs thereof. Such compounds may also be obtained from any available source, including systematic libraries of natural and/or synthetic compounds. The preferred assay components for use in this embodiment is a cancer marker identified herein, the known binding partner and/or substrate of same, and the test compound. Test compounds can be supplied from any source.

The basic principle of the assay systems used to identify compounds that interfere with the interaction between the marker and its binding partner involves preparing a reaction mixture containing the marker and its binding partner under conditions and for a time sufficient to allow the two products to interact and bind, thus forming a complex. In order to test an agent for inhibitory activity, the reaction mixture is prepared in the presence and absence of the test compound. The test compound can be initially included in the reaction mixture, or can be added at a time subsequent to the addition of the marker and its binding partner. Control reaction mixtures are incubated without the test compound or with a placebo. The formation of any complexes between the marker and its binding partner is then detected. The formation of a complex in the control reaction, but less or no such formation in the reaction mixture containing the test compound, indicates that the compound interferes with the interaction of the marker and its binding partner. Conversely, the formation of more complex in the presence of compound than in the control reaction indicates that the compound may enhance interaction of the marker and its binding partner. The assay for compounds that interfere with the interaction of the marker with its binding partner may be conducted in a heterogeneous or homogeneous format. Heterogeneous assays involve anchoring either the marker or its binding partner onto a solid phase and detecting complexes anchored to the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the markers and the binding partners (e.g., by competition) can be identified by conducting the reaction in the presence of the test substance, i.e., by adding the test substance to the reaction mixture prior to or simultaneously with the marker and its interactive binding partner. Alternatively, test compounds that disrupt preformed complexes, e.g., compounds with higher binding constants that displace one of the components from the complex, can be tested by adding the test compound to the reaction mixture after complexes have been formed. The various formats are briefly described below.

In a heterogeneous assay system, either the marker or its binding partner is anchored onto a solid surface or matrix, while the other corresponding non-anchored component may be labeled, either directly or indirectly. In practice, microtitre plates are often utilized for this approach. The anchored species can be immobilized by a number of methods, either non-covalent or covalent, that are typically well known to one who practices the art. Non-covalent attachment can often be accomplished simply by coating the solid surface with a solution of the marker or its binding partner and drying. Alternatively, an immobilized antibody specific for the assay component to be anchored can be used for this purpose. Such surfaces can often be prepared in advance and stored.

In related embodiments, a fusion protein can be provided which adds a domain that allows one or both of the assay components to be anchored to a matrix. For example, glutathione-S-transferase/marker fusion proteins or glutathione-S-transferase/binding partner can be adsorbed onto glutathione sepharose beads (Sigma Chemical, St. Louis, Mo.) or glutathione derivatized microtiter plates, which are then combined with the test compound or the test compound and either the non-adsorbed marker or its binding partner, and the mixture incubated under conditions conducive to complex formation (e.g., physiological conditions). Following incubation, the beads or microtiter plate wells are washed to remove any unbound assay components, the immobilized complex assessed either directly or indirectly, for example, as described above. Alternatively, the complexes can be dissociated from the matrix, and the level of marker binding or activity determined using standard techniques.

Other techniques for immobilizing proteins on matrices can also be used in the screening assays of the invention. For example, either a marker or a marker binding partner can be immobilized utilizing conjugation of biotin and streptavidin. Biotinylated marker protein or target molecules can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the protein-immobilized surfaces can be prepared in advance and stored.

In order to conduct the assay, the corresponding partner of the immobilized assay component is exposed to the coated surface with or without the test compound. After the reaction is complete, unreacted assay components are removed (e.g., by washing) and any complexes formed will remain immobilized on the solid surface. The detection of complexes anchored on the solid surface can be accomplished in a number of ways. Where the non-immobilized component is pre-labeled, the detection of label immobilized on the surface indicates that complexes were formed. Where the non-immobilized component is not pre-labeled, an indirect label can be used to detect complexes anchored on the surface; e.g., using a labeled antibody specific for the initially non-immobilized species (the antibody, in turn, can be directly labeled or indirectly labeled with, e.g., a labeled anti-Ig antibody). Depending upon the order of addition of reaction components, test compounds which modulate (inhibit or enhance) complex formation or which disrupt preformed complexes can be detected.

In an alternate embodiment of the invention, a homogeneous assay may be used. This is typically a reaction, analogous to those mentioned above, which is conducted in a liquid phase in the presence or absence of the test compound. The formed complexes are then separated from unreacted components, and the amount of complex formed is determined. As mentioned for heterogeneous assay systems, the order of addition of reactants to the liquid phase can yield information about which test compounds modulate (inhibit or enhance) complex formation and which disrupt preformed complexes.

In such a homogeneous assay, the reaction products may be separated from unreacted assay components by any of a number of standard techniques, including but not limited to: differential centrifugation, chromatography, electrophoresis and immunoprecipitation. In differential centrifugation, complexes of molecules may be separated from uncomplexed molecules through a series of centrifugal steps, due to the different sedimentation equilibria of complexes based on their different sizes and densities (see, for example, Rivas, G., and Minton, A. P., *Trends Biochem Sci* 1993 August; 18(8): 284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the complex as compared to the uncomplexed molecules may be exploited to differentially separate the complex from the remaining individual reactants, for example through the use of ion-exchange chromatography resins. Such resins and chromatographic techniques are well known to one skilled in the art (see, e.g., Heegaard, 1998, *J. Mol. Recognit.* 11: 141-148; Hage and Tweed, 1997, *J. Chromatogr. B. Biomed. Sci. Appl.,* 699:499-525). Gel electrophoresis may also be employed to separate complexed molecules from unbound species (see, e.g., Ausubel et al (eds.), In: *Current Protocols in Molecular Biology*, J. Wiley & Sons, New York. 1999). In this technique, protein or nucleic acid complexes are separated based on size or charge, for example. In order to maintain the binding interaction during the electrophoretic process, nondenaturing gels in the absence of reducing agent are typically preferred, but conditions appropriate to the particular interactants will be well known to one skilled in the art. Immunoprecipitation is another common technique utilized for the isolation of a protein-protein complex from solution (see, e.g., Ausubel et al (eds.), In: *Current Protocols in Molecular Biology*, J. Wiley & Sons, New York. 1999). In this technique, all proteins binding to an antibody specific to one of the binding molecules are precipitated from solution by conjugating the antibody to a polymer bead that may be readily collected by centrifugation. The bound assay components are released from the beads (through a specific proteolysis event or other technique well known in the art which will not disturb the protein-protein interaction in the complex), and a second immunoprecipitation step is performed, this time utilizing antibodies specific for the correspondingly different interacting assay component. In this manner, only formed complexes should remain attached to the beads. Variations in complex formation in both the presence and the absence of a test compound can be compared, thus offering information about the ability of the compound to modulate interactions between the marker and its binding partner.

Also within the scope of the present invention are methods for direct detection of interactions between the marker and its natural binding partner and/or a test compound in a homogeneous or heterogeneous assay system without further sample manipulation. For example, the technique of fluorescence energy transfer may be utilized (see, e.g., Lakowicz et al, U.S. Pat. No. 5,631,169; Stavrianopoulos et al, U.S. Pat. No. 4,868,103). Generally, this technique involves the addition of a fluorophore label on a first 'donor' molecule (e.g., marker or test compound) such that its emitted fluorescent energy will be absorbed by a fluorescent label on a second, 'acceptor' molecule (e.g., marker or test compound), which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter). A test substance which either enhances or hinders participation of one of the species in the preformed complex will result in the generation of a signal variant to that of background. In this way, test substances that modulate interactions between a marker and its binding partner can be identified in controlled assays.

In another embodiment, modulators of marker expression are identified in a method wherein a cell is contacted with a candidate compound and the expression of mRNA or protein, corresponding to a marker in the cell, is determined. The level of expression of mRNA or protein in the presence of the candidate compound is compared to the level of expression of mRNA or protein in the absence of the candidate compound. The candidate compound can then be identified as a modulator of marker expression based on this comparison. For example, when expression of marker mRNA or protein is greater (statistically significantly greater) in the presence of the candidate compound than in its absence, the candidate compound is identified as a stimulator of marker mRNA or protein expression. Conversely, when expression of marker mRNA or protein is less (statistically significantly less) in the presence of the candidate compound than in its absence, the candidate compound is identified as an inhibitor of marker mRNA or protein expression. The level of marker mRNA or protein expression in the cells can be determined by methods described herein for detecting marker mRNA or protein.

In another aspect, the invention pertains to a combination of two or more of the assays described herein. For example, a modulating agent can be identified using a cell-based or a cell free assay, and the ability of the agent to modulate the activity of a marker protein can be further confirmed in vivo, e.g., in a whole animal model for cancer, cellular transformation and/or tumorigenesis. Animal models of lung cancer are described in, for example, Tanaka, E., et al. (2003) *Chest* 123:1248-1253., Jackson E L, et al (2001) *Genes Dev* 15(24): 3243-8, and Fisher G H, et al. (2001) *Genes Dev* 15(24):3249-62, the contents of which are expressly incorporated herein by reference.

Additional animal based models of cancer are well known in the art (reviewed in Animal Models of Cancer Predisposition Syndromes, Hiai, H and Hino, O (eds.) 1999, *Progress in Experimental Tumor Research*, Vol. 35; Clarke A R *Carcinogenesis* (2000) 21:435-41) and include, for example, carcinogen-induced tumors (Rithidech, K et al. *Mutat Res* (1999) 428:33-39; Miller, M L et al. *Environ Mol Mutagen* (2000) 35:319-327), injection and/or transplantation of tumor cells into an animal, as well as animals bearing mutations in growth regulatory genes, for example, oncogenes (e.g., ras) (Arbeit, J M et al. *Am J Pathol* (1993) 142:1187-1197; Sinn, E et al. *Cell* (1987) 49:465-475; Thorgeirsson, S S et al *Toxicol Lett* (2000) 112-113:553-555) and tumor suppressor genes (e.g., p53) (Vooijs, M et al. *Oncogene* (1999) 18:5293-5303; Clark A R *Cancer Metast Rev* (1995) 14:125-148; Kumar, T R et al. *J Intern Med* (1995) 238:233-238; Donehower, L A et al. (1992) Nature 356215-221). Furthermore, experimental model systems are available for the study of, for example, ovarian cancer (Hamilton, T C et al. *Semin Oncol* (1984) 11:285-298; Rahman, N A et al. *Mol Cell Endocrinol* (1998) 145:167-174; Beamer, W G et al. *Toxicol Pathol* (1998) 26:704-710), gastric cancer (Thompson, J et al. *Int J Cancer* (2000) 86:863-869; Fodde, R et al. *Cytogenet Cell Genet* (1999) 86:105-111), breast cancer (Li, M et al. *Oncogene* (2000) 19:1010-1019; Green, J E et al. *Oncogene* (2000) 19:1020-1027), melanoma (Satyamoorthy, K et al. *Cancer Metast Rev* (1999)18:401-405), and prostate cancer (Shirai, T et al. *Mutat Res* (2000) 462:219-226; Bostwick, D G et al. *Prostate* (2000) 43:286-294). Animal models described in, for example, Chin L. et al (1999) *Nature* 400(6743):468-72, may also be used in the methods of the invention.

This invention further pertains to novel agents identified by the above-described screening assays. Accordingly, it is within the scope of this invention to further use an agent identified as described herein in an appropriate animal model. For example, an agent identified as described herein (e.g., a marker modulating agent, a small molecule, an antisense marker nucleic acid molecule, a ribozyme, a marker-specific antibody, or fragment thereof, a marker protein, a marker nucleic acid molecule, an RNA interfering agent, e.g., an siRNA molecule targeting a marker of the invention, or a marker-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

VIII. PHARMACEUTICAL COMPOSITIONS

The small molecules, peptides, peptoids, peptidomimetics, polypeptides, RNA interfering agents, e.g., siRNA molecules, antibodies, ribozymes, and antisense oligonucleotides (also referred to herein as "active compounds" or "compounds") corresponding to a marker of the invention can be incorporated into pharmaceutical compositions suitable for administration. Such compositions typically comprise the small molecules, peptides, peptoids, peptidomimetics, polypeptides, RNA interfering agents, e.g., siRNA molecules, antibodies, ribozymes, or antisense oligonucleotides and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The invention includes methods for preparing pharmaceutical compositions for modulating the expression or activity of a polypeptide or nucleic acid corresponding to a marker of the invention. Such methods comprise formulating a pharmaceutically acceptable carrier with an agent which modulates expression or activity of a polypeptide or nucleic acid corresponding to a marker of the invention. Such compositions can further include additional active agents. Thus, the invention further includes methods for preparing a pharmaceutical composition by formulating a pharmaceutically acceptable carrier with an agent which modulates expression or activity of a polypeptide or nucleic acid corresponding to a marker of the invention and one or more additional active compounds.

It is understood that appropriate doses of small molecule agents and protein or polypeptide agents depends upon a number of factors within the knowledge of the ordinarily skilled physician, veterinarian, or researcher. The dose(s) of these agents will vary, for example, depending upon the identity, size, and condition of the subject or sample being treated, further depending upon the route by which the composition is to be administered, if applicable, and the effect which the practitioner desires the agent to have upon the nucleic acid molecule or polypeptide of the invention. Small molecules include, but are not limited to, peptides, peptidomimetics, amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Exemplary doses of a small molecule include milligram or microgram amounts per kilogram of subject or sample weight (e.g. about 1 microgram per kilogram to about 500 milligrams per kilogram, about 100 micrograms per kilogram to about 5 milligrams per kilogram, or about 1 microgram per kilogram to about 50 micrograms per kilogram).

As defined herein, a therapeutically effective amount of an RNA interfering agent, e.g., siRNA, (i.e., an effective dosage) ranges from about 0.001 to 3,000 mg/kg body weight, preferably about 0.01 to 2500 mg/kg body weight, more preferably about 0.1 to 2000, about 0.1 to 1000 mg/kg body weight, 0.1 to 500 mg/kg body weight, 0.1 to 100 mg/kg body weight, 0.1 to 50 mg/kg body weight, 0.1 to 25 mg/kg body weight, and even more preferably about 1 to 10 mg/kg, 2 to 9 mg/kg, 3 to 8 mg/kg, 4 to 7 mg/kg, or 5 to 6 mg/kg body weight. Treatment of a subject with a therapeutically effective amount of an RNA interfering agent can include a single treatment or, preferably, can include a series of treatments. In a preferred example, a subject is treated with an RNA interfering agent in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks.

Exemplary doses of a protein or polypeptide include gram, milligram or microgram amounts per kilogram of subject or sample weight (e.g. about 1 microgram per kilogram to about 5 grams per kilogram, about 100 micrograms per kilogram to about 500 milligrams per kilogram, or about 1 milligram per kilogram to about 50 milligrams per kilogram). It is furthermore understood that appropriate doses of one of these agents depend upon the potency of the agent with respect to the expression or activity to be modulated. Such appropriate doses can be determined using the assays described herein. When one or more of these agents is to be administered to an animal (e.g. a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific agent employed, the age, body weight, general health, gender, and diet of the subject, the time of administration, the route of administration, the rate of excretion, any drug combination, and the degree of expression or activity to be modulated.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediamine-tetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL (BASF; Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a polypeptide or antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium, and then incorporating the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, and/or adjuvant materials can be included as part of the composition. The tablets, pills, capsules, troches, and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from a pressurized container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes having monoclonal antibodies incorporated therein or thereon) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

For antibodies, the preferred dosage is 0.1 mg/kg to 100 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the epithelium). A method for lipidation of antibodies is described by Cruikshank et al. (1997) *J. Acquired Immune Deficiency Syndromes and Human Retrovirology* 14:193.

The nucleic acid molecules corresponding to a marker of the invention can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al., 1994, *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g. retroviral vectors, the pharmaceutical preparation can include one or more cells which produce the gene delivery system.

The RNA interfering agents, e.g., siRNAs used in the methods of the invention can be inserted into vectors. These constructs can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the vector can include the RNA interfering agent, e.g., the siRNA vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

IX. PREDICTIVE MEDICINE

The present invention also pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining the amount, structure, and/or activity of polypeptides or nucleic acids corresponding to one or more markers of the invention, in order to determine whether an individual is at risk of developing cancer. Such assays can be used for prognostic or predictive purposes to thereby prophylactically treat an individual prior to the onset of the cancer.

Yet another aspect of the invention pertains to monitoring the influence of agents (e.g., drugs or other compounds administered either to inhibit cancer or to treat or prevent any other disorder {i.e. in order to understand any carcinogenic effects that such treatment may have}) on the amount, structure, and/or activity of a marker of the invention in clinical trials. These and other agents are described in further detail in the following sections.

A. Diagnostic Assays

1. Methods for Detection of Copy Number

Methods of evaluating the copy number of a particular marker or chromosomal region (e.g., an MCR) are well known to those of skill in the art. The presence or absence of chromosomal gain or loss can be evaluated simply by a determination of copy number of the regions or markers identified herein.

Methods for evaluating copy number of encoding nucleic acid in a sample include, but are not limited to, hybridization-based assays. For example, one method for evaluating the copy number of encoding nucleic acid in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal mRNA (e.g., a non-amplified portion of the same or related cell, tissue, organ, etc.) provides an estimate of the relative copy number of the target nucleic acid.

An alternative means for determining the copy number is in situ hybridization (e.g., Angerer (1987) Meth. Enzynmol 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application.

Preferred hybridization-based assays include, but are not limited to, traditional "direct probe" methods such as Southern blots or in situ hybridization (e.g., FISH and FISH plus SKY), and "comparative probe" methods such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained.

The probes are typically labeled, e.g., with radioisotopes or fluorescent reporters. Preferred probes are sufficiently long so as to specifically hybridize with the target nucleic acid(s) under stringent conditions. The preferred size range is from about 200 bases to about 1000 bases.

In some applications it is necessary to block the hybridization capacity of repetitive sequences. Thus, in some embodiments, tRNA, human genomic DNA, or Cot-I DNA is used to block non-specific hybridization.

In CGH methods, a first collection of nucleic acids (e.g., from a sample, e.g., a possible tumor) is labeled with a first label, while a second collection of nucleic acids (e.g., a control, e.g., from a healthy cell/tissue) is labeled with a second label. The ratio of hybridization of the nucleic acids is determined by the ratio of the two (first and second) labels binding to each fiber in the array. Where there are chromosomal deletions or multiplications, differences in the ratio of the signals from the two labels will be detected and the ratio will provide a measure of the copy number. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Hybridization protocols suitable for use with the methods of the invention are described, e.g., in Albertson (1984) EMBO J. 3: 1227-1234; Pinkel (1988) Proc. Natl. Acad. Sci. USA 85: 9138-9142; EPO Pub. No. 430,402; Methods in Molecular Biology, Vol. 33: In situ Hybridization Protocols, Choo, ed., Humana Press, Totowa, N.J. (1994), etc. In one embodiment, the hybridization protocol of Pinkel, et al. (1998) Nature Genetics 20: 207-211, or of Kallioniemi (1992) Proc. Natl. Acad Sci USA 89:5321-5325 (1992) is used.

The methods of the invention are particularly well suited to array-based hybridization formats. Array-based CGH is described in U.S. Pat. No. 6,455,258, the contents of which are incorporated herein by reference.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis, et al. (1990) PCR Protocols, *A Guide to Methods and Applications*, Academic Press, Inc. N.Y.). Measurement of DNA copy number at microsatellite loci using quantitative PCR analysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the invention. In fluorogenic quantitative PCR, quantitation is based on amount of fluorescence signals, e.g., TaqMan and sybr green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Loss of heterozygosity (LOH) mapping (Wang, Z. C., et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93) may also be used to identify regions of amplification or deletion.

2. Methods for Detection of Gene Expression

Marker expression level can also be assayed as a method for diagnosis of cancer or risk for developing cancer. Expression of a marker of the invention may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

Methods of detecting and/or quantifying the gene transcript (mRNA or cDNA made therefrom) using nucleic acid hybridization techniques are known to those of skill in the art (see Sambrook et al. supra). For example, one method for evaluating the presence, absence, or quantity of cDNA involves a Southern transfer as described above. Briefly, the mRNA is isolated (e.g. using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the target cDNA.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

There are many established methods for anchoring assay components to a solid phase. These include, without limitation, marker or probe molecules which are immobilized through conjugation of biotin and streptavidin. Such biotinylated assay components can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the surfaces with immobilized assay components can be prepared in advance and stored.

Other suitable carriers or solid phase supports for such assays include any material capable of binding the class of molecule to which the marker or probe belongs. Well-known supports or carriers include, but are not limited to, glass, polystyrene, nylon, polypropylene, polyethylene, dextran, amylases, natural and modified celluloses, polyacrylamides, gabbros, and magnetite.

In order to conduct assays with the above-mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein.

In a preferred embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al, U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S, and Urbaniczky, C., 1991, *Anal. Chem.* 63:2338-2345 and Szabo et al., 1995, *Curr. Opin. Struct. Biol.* 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example, through the utilization of ion-exchange chromatography resins. Such resins and chromatographic techniques are well known to one skilled in the art (see, e.g., Heegaard, N. H., 1998, *J. Mol. Recognit.* Winter 11(1-6):141-8; Hage, D. S., and Tweed, S. A. *J Chromatogr B Biomed Sci Appl* 1997 Oct. 10; 699(1-2):499-525). Gel electrophoresis may also be employed to separate complexed assay components from unbound components (see, e.g., Ausubel et al, ed., *Current Protocols in Molecular Biology*, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

In a particular embodiment, the level of mRNA corresponding to the marker can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated nucleic acid can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

The probes can be full length or less than the full length of the nucleic acid sequence encoding the protein. Shorter probes are empirically tested for specificity. Preferably nucleic acid probes are 20 bases or longer in length. (See, e.g., Sambrook et al. for methods of selecting nucleic acid probe sequences for use in nucleic acid hybridization.) Visualization of the hybridized portions allows the qualitative determination of the presence or absence of cDNA.

An alternative method for determining the level of a transcript corresponding to a marker of the present invention in a sample involves the process of nucleic acid amplification, e.g., by rtPCR (the experimental embodiment set forth in Mullis, 1987, U.S. Pat. No. 4,683,202), ligase chain reaction (Barany, 1991, *Proc. Natl. Acad. Sci. USA*, 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. Fluorogenic rtPCR may also be used in the methods of the invention. In fluorogenic rtPCR, quantitation is based on amount of fluorescence signals, e.g., TaqMan and sybr green. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cells prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a non-cancerous sample, or between samples from different sources.

Alternatively, the expression level can be provided as a relative expression level. To determine a relative expression level of a marker, the level of expression of the marker is determined for 10 or more samples of normal versus cancer cell isolates, preferably 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

Preferably, the samples used in the baseline determination will be from cancer cells or normal cells of the same tissue type. The choice of the cell source is dependent on the use of the relative expression level. Using expression found in normal tissues as a mean expression score aids in validating whether the marker assayed is specific to the tissue from which the cell was derived (versus normal cells). In addition, as more data is accumulated, the mean expression value can be revised, providing improved relative expression values based on accumulated data. Expression data from normal cells provides a means for grading the severity of the cancer state.

In another preferred embodiment, expression of a marker is assessed by preparing genomic DNA or mRNA/cDNA (i.e. a transcribed polynucleotide) from cells in a subject sample, and by hybridizing the genomic DNA or mRNA/cDNA with a reference polynucleotide which is a complement of a polynucleotide comprising the marker, and fragments thereof cDNA can, optionally, be amplified using any of a variety of polymerase chain reaction methods prior to hybridization with the reference polynucleotide. Expression of one or more markers can likewise be detected using quantitative PCR (QPCR) to assess the level of expression of the marker(s). Alternatively, any of the many known methods of detecting mutations or variants (e.g. single nucleotide polymorphisms, deletions, etc.) of a marker of the invention may be used to detect occurrence of a mutated marker in a subject.

In a related embodiment, a mixture of transcribed polynucleotides obtained from the sample is contacted with a substrate having fixed thereto a polynucleotide complementary to or homologous with at least a portion (e.g. at least 7, 10, 15, 20, 25, 30, 40, 50, 100, 500, or more nucleotide residues) of a marker of the invention. If polynucleotides complementary to or homologous with are differentially detectable on the substrate (e.g. detectable using different chromophores or fluorophores, or fixed to different selected positions), then the levels of expression of a plurality of markers can be assessed simultaneously using a single substrate (e.g. a "gene chip" microarray of polynucleotides fixed at selected positions). When a method of assessing marker expression is used which involves hybridization of one nucleic acid with another, it is preferred that the hybridization be performed under stringent hybridization conditions.

In another embodiment, a combination of methods to assess the expression of a marker is utilized.

Because the compositions, kits, and methods of the invention rely on detection of a difference in expression levels or copy number of one or more markers of the invention, it is preferable that the level of expression or copy number of the marker is significantly greater than the minimum detection limit of the method used to assess expression or copy number in at least one of normal cells and cancerous cells.

3. Methods for Detection of Expressed Protein

The activity or level of a marker protein can also be detected and/or quantified by detecting or quantifying the expressed polypeptide. The polypeptide can be detected and quantified by any of a number of means well known to those of skill in the art. These may include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, and the like. A skilled artisan can readily adapt known protein/antibody detection methods for use in determining whether cells express a marker of the present invention.

A preferred agent for detecting a polypeptide of the invention is an antibody capable of binding to a polypeptide corresponding to a marker of the invention, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In a preferred embodiment, the antibody is labeled, e.g. a radio-labeled, chromophore-labeled, fluorophore-labeled, or enzyme-labeled antibody. In another embodiment, an antibody derivative (e.g. an antibody conjugated with a substrate or with the protein or ligand of a protein-ligand pair {e.g. biotin-streptavidin}), or an antibody fragment (e.g. a single-chain antibody, an isolated antibody hypervariable domain, etc.) which binds specifically with a protein corresponding to the marker, such as the protein encoded by the open reading frame corresponding to the marker or such a protein which has undergone all or a portion of its normal post-translational modification, is used.

Proteins from cells can be isolated using techniques that are well known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, N.Y.).

In one format, antibodies, or antibody fragments, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means. Means of detecting proteins using electrophoretic techniques are well known to those of skill in the art (see generally, R. Scopes (1982) *Protein Purification*, Springer-Verlag, N.Y.; Deutscher, (1990) *Methods in Enzymology* Vol. 182: *Guide to Protein Purification*, Academic Press, Inc., N.Y.).

In another preferred embodiment, Western blot (immunoblot) analysis is used to detect and quantify the presence of a polypeptide in the sample. This technique generally comprises separating sample proteins by gel electrophoresis on the basis of molecular weight, transferring the separated proteins to a suitable solid support, (such as a nitrocellulose filter, a nylon filter, or derivatized nylon filter), and incubating the sample with the antibodies that specifically bind a polypeptide. The anti-polypeptide antibodies specifically bind to the polypeptide on the solid support. These antibodies may be directly labeled or alternatively may be subsequently detected using labeled antibodies (e.g., labeled sheep anti-human antibodies) that specifically bind to the anti-polypeptide.

In a more preferred embodiment, the polypeptide is detected using an immunoassay. As used herein, an immunoassay is an assay that utilizes an antibody to specifically bind to the analyte. The immunoassay is thus characterized by detection of specific binding of a polypeptide to an anti-antibody as opposed to the use of other physical or chemical properties to isolate, target, and quantify the analyte.

The polypeptide is detected and/or quantified using any of a number of well recognized immunological binding assays (see, e.g., U.S. Pat. Nos. 4,366,241; 4,376,110; 4,517,288; and 4,837,168). For a review of the general immunoassays, see also Asai (1993) *Methods in Cell Biology* Volume 37: *Antibodies in Cell Biology*, Academic Press, Inc. New York; Stites & Terr (1991) *Basic and Clinical Immunology* 7th Edition.

Immunological binding assays (or immunoassays) typically utilize a "capture agent" to specifically bind to and often immobilize the analyte (polypeptide or subsequence). The capture agent is a moiety that specifically binds to the analyte. In a preferred embodiment, the capture agent is an antibody that specifically binds a polypeptide. The antibody (anti-peptide) may be produced by any of a number of means well known to those of skill in the art.

Immunoassays also often utilize a labeling agent to specifically bind to and label the binding complex formed by the capture agent and the analyte. The labeling agent may itself be one of the moieties comprising the antibody/analyte complex. Thus, the labeling agent may be a labeled polypeptide or a labeled anti-antibody. Alternatively, the labeling agent may be a third moiety, such as another antibody, that specifically binds to the antibody/polypeptide complex.

In one preferred embodiment, the labeling agent is a second human antibody bearing a label. Alternatively, the second antibody may lack a label, but it may, in turn, be bound by a labeled third antibody specific to antibodies of the species from which the second antibody is derived. The second can be modified with a detectable moiety, e.g. as biotin, to which a third labeled molecule can specifically bind, such as enzyme-labeled streptavidin.

Other proteins capable of specifically binding immunoglobulin constant regions, such as protein A or protein G may also be used as the label agent. These proteins are normal constituents of the cell walls of streptococcal bacteria. They exhibit a strong non-immunogenic reactivity with immunoglobulin constant regions from a variety of species (see, generally Kronval, et al. (1973) *J. Immunol.*, 111: 1401-1406, and Akerstrom (1985) *J. Immunol.*, 135: 2589-2542).

As indicated above, immunoassays for the detection and/or quantification of a polypeptide can take a wide variety of formats well known to those of skill in the art.

Preferred immunoassays for detecting a polypeptide are either competitive or noncompetitive. Noncompetitive immunoassays are assays in which the amount of captured analyte is directly measured. In one preferred "sandwich" assay, for example, the capture agent (anti-peptide antibodies) can be bound directly to a solid substrate where they are immobilized. These immobilized antibodies then capture polypeptide present in the test sample. The polypeptide thus immobilized is then bound by a labeling agent, such as a second human antibody bearing a label.

In competitive assays, the amount of analyte (polypeptide) present in the sample is measured indirectly by measuring the amount of an added (exogenous) analyte (polypeptide) displaced (or competed away) from a capture agent (anti-peptide antibody) by the analyte present in the sample. In one competitive assay, a known amount of, in this case, a polypeptide is added to the sample and the sample is then contacted with a capture agent. The amount of polypeptide bound to the antibody is inversely proportional to the concentration of polypeptide present in the sample.

In one particularly preferred embodiment, the antibody is immobilized on a solid substrate. The amount of polypeptide bound to the antibody may be determined either by measuring the amount of polypeptide present in a polypeptide/antibody complex, or alternatively by measuring the amount of remaining uncomplexed polypeptide. The amount of polypeptide may be detected by providing a labeled polypeptide.

The assays of this invention are scored (as positive or negative or quantity of polypeptide) according to standard methods well known to those of skill in the art. The particular method of scoring will depend on the assay format and choice of label. For example, a Western Blot assay can be scored by visualizing the colored product produced by the enzymatic label. A clearly visible colored band or spot at the correct molecular weight is scored as a positive result, while the absence of a clearly visible spot or band is scored as a negative. The intensity of the band or spot can provide a quantitative measure of polypeptide.

Antibodies for use in the various immunoassays described herein, can be produced as described herein.

In another embodiment, level (activity) is assayed by measuring the enzymatic activity of the gene product. Methods of assaying the activity of an enzyme are well known to those of skill in the art.

In vivo techniques for detection of a marker protein include introducing into a subject a labeled antibody directed against the protein. For example, the antibody can be labeled with a radioactive marker whose presence and location in a subject can be detected by standard imaging techniques.

Certain markers identified by the methods of the invention may be secreted proteins. It is a simple matter for the skilled artisan to determine whether any particular marker protein is a secreted protein. In order to make this determination, the marker protein is expressed in, for example, a mammalian cell, preferably a human cell line, extracellular fluid is collected, and the presence or absence of the protein in the extracellular fluid is assessed (e.g. using a labeled antibody which binds specifically with the protein).

The following is an example of a method which can be used to detect secretion of a protein. About $8 \times 10^5$ 293T cells are incubated at 37° C. in wells containing growth medium (Dulbecco's modified Eagle's medium {DMEM} supplemented with 10% fetal bovine serum) under a 5% (v/v) $CO_2$, 95% air atmosphere to about 60-70% confluence. The cells are then transfected using a standard transfection mixture comprising 2 micrograms of DNA comprising an expression vector encoding the protein and 10 microliters of LipofectAMINE™ (GIBCO/BRL Catalog no. 18342-012) per well. The transfection mixture is maintained for about 5 hours, and then replaced with fresh growth medium and maintained in an air atmosphere. Each well is gently rinsed twice with DMEM which does not contain methionine or cysteine (DMEM-MC; ICN Catalog no. 16-424-54). About 1 milliliter of DMEM-MC and about 50 microcuries of Trans-$^{35}$S™ reagent (ICN Catalog no. 51006) are added to each well. The wells are maintained under the 5% $CO_2$ atmosphere described above and incubated at 37° C. for a selected period. Following incubation, 150 microliters of conditioned medium is removed and centrifuged to remove floating cells and debris. The presence of the protein in the supernatant is an indication that the protein is secreted.

It will be appreciated that subject samples, e.g., a sample containing tissue, whole blood, serum, plasma, buccal scrape, saliva, cerebrospinal fluid, urine, stool, bronchoalveolar lavage, and lung tissue, may contain cells therein, particularly when the cells are cancerous, and, more particularly, when the cancer is metastasizing, and thus may be used in the methods of the present invention. The cell sample can, of course, be subjected to a variety of well-known post-collection preparative and storage techniques (e.g., nucleic acid and/or protein extraction, fixation, storage, freezing, ultrafiltration, concentration, evaporation, centrifugation, etc.) prior to assessing the level of expression of the marker in the sample. Thus, the compositions, kits, and methods of the invention can be used to detect expression of markers corresponding to proteins having at least one portion which is displayed on the surface of cells which express it. It is a simple matter for the skilled artisan to determine whether the protein corresponding to any particular marker comprises a cell-surface protein. For example, immunological methods may be used to detect such proteins on whole cells, or well known computer-based sequence analysis methods (e.g. the SIGNALP program; Nielsen et al., 1997, *Protein Engineering* 10:1-6) may be used to predict the presence of at least one extracellular domain (i.e. including both secreted proteins and proteins having at least one cell-surface domain). Expression of a marker corresponding to a protein having at least one portion which is displayed on the surface of a cell which expresses it may be detected without necessarily lysing the cell (e.g. using a labeled antibody which binds specifically with a cell-surface domain of the protein).

The invention also encompasses kits for detecting the presence of a polypeptide or nucleic acid corresponding to a marker of the invention in a biological sample, e.g., a sample containing tissue, whole blood, serum, plasma, buccal scrape, saliva, cerebrospinal fluid, urine, stool, bronchoalveolar lavage, and lung tissue. Such kits can be used to determine if a subject is suffering from or is at increased risk of developing cancer. For example, the kit can comprise a labeled compound or agent capable of detecting a polypeptide or an mRNA encoding a polypeptide corresponding to a marker of the invention in a biological sample and means for determining the amount of the polypeptide or mRNA in the sample (e.g., an antibody which binds the polypeptide or an oligonucleotide probe which binds to DNA or mRNA encoding the polypeptide). Kits can also include instructions for interpreting the results obtained using the kit.

For antibody-based kits, the kit can comprise, for example: (1) a first antibody (e.g., attached to a solid support) which binds to a polypeptide corresponding to a marker of the invention; and, optionally, (2) a second, different antibody which binds to either the polypeptide or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a polypeptide corresponding to a marker of the invention or (2) a pair of primers useful for amplifying a nucleic acid molecule corresponding to a marker of the invention. The kit can also comprise, e.g., a buffering agent, a preservative, or a protein stabilizing agent. The kit can further comprise components necessary for detecting the detectable label (e.g., an enzyme or a substrate). The kit can also contain a control sample or a series of control samples which can be assayed and compared to the test sample. Each component of the kit can be enclosed within an individual container and all of the various containers can be within a single package, along with instructions for interpreting the results of the assays performed using the kit.

4. Method for Detecting Structural Alterations

The invention also provides a method for assessing whether a subject is afflicted with cancer or is at risk for developing cancer by comparing the structural alterations, e.g., mutations or allelic variants, of a marker in a cancer sample with the structural alterations, e.g., mutations of a marker in a normal, e.g., control sample. The presence of a structural alteration, e.g., mutation or allelic variant in the marker in the cancer sample is an indication that the subject is afflicted with cancer.

A preferred detection method is allele specific hybridization using probes overlapping the polymorphic site and having about 5, 10, 20, 25, or 30 nucleotides around the polymorphic region. In a preferred embodiment of the invention, several probes capable of hybridizing specifically to allelic variants are attached to a solid phase support, e.g., a "chip". Oligonucleotides can be bound to a solid support by a variety of processes, including lithography. For example a chip can hold up to 250,000 oligonucleotides (GeneChip, Affymetrix™). Mutation detection analysis using these chips comprising oligonucleotides, also termed "DNA probe arrays" is described e.g., in Cronin et al. (1996) *Human Mutation* 7:244. In one embodiment, a chip comprises all the allelic variants of at least one polymorphic region of a gene. The solid phase support is then contacted with a test nucleic acid and hybridization to the specific probes is detected. Accordingly, the identity of numerous allelic variants of one or more genes can be identified in a simple hybridization experiment. For example, the identity of the allelic variant of the nucleotide polymorphism in the 5' upstream regulatory element can be determined in a single hybridization experiment.

In other detection methods, it is necessary to first amplify at least a portion of a marker prior to identifying the allelic variant. Amplification can be performed, e.g., by PCR and/or LCR (see Wu and Wallace (1989) *Genomics* 4:560), according to methods known in the art. In one embodiment, genomic DNA of a cell is exposed to two PCR primers and amplification for a number of cycles sufficient to produce the required amount of amplified DNA. In preferred embodiments, the primers are located between 150 and 350 base pairs apart.

Alternative amplification methods include: self sustained sequence replication (Guatelli, J. C. et al., (1990) *Proc. Natl. Acad. Sci. USA* 87:1874-1878), transcriptional amplification system (Kwoh, D. Y. et al., (1989) *Proc. Natl. Acad. Sci. USA* 86:1173-1177), Q-Beta Replicase (Lizardi, P. M. et al., (1988) *Bio/Technology* 6:1197), and self-sustained sequence replication (Guatelli et al., (1989) *Proc. Nat. Acad. Sci.* 87:1874), and nucleic acid based sequence amplification (NABSA), or any other nucleic acid amplification method, followed by the detection of the amplified molecules using techniques well known to those of skill in the art. These detection schemes are especially useful for the detection of nucleic acid molecules if such molecules are present in very low numbers.

In one embodiment, any of a variety of sequencing reactions known in the art can be used to directly sequence at least a portion of a marker and detect allelic variants, e.g., mutations, by comparing the sequence of the sample sequence with the corresponding reference (control) sequence. Exemplary sequencing reactions include those based on techniques developed by Maxam and Gilbert (*Proc. Natl. Acad Sci USA* (1977) 74:560) or Sanger (Sanger et al. (1977) *Proc. Nat. Acad. Sci.* 74:5463). It is also contemplated that any of a variety of automated sequencing procedures may be utilized when performing the subject assays (*Biotechniques* (1995) 19:448), including sequencing by mass spectrometry (see, for example, U.S. Pat. No. 5,547,835 and international patent application Publication Number WO 94/16101, entitled *DNA Sequencing by Mass Spectrometry* by H. Köster; U.S. Pat. No. 5,547,835 and international patent application Publication Number WO 94/21822 entitled *DNA Sequencing by Mass Spectrometry Via Exonuclease Degradation* by H. Köster), and U.S. Pat. No. 5,605,798 and International Patent Application No. PCT/US96/03651 entitled *DNA Diagnostics Based on Mass Spectrometry* by H. Köster; Cohen et al. (1996) *Adv Chromatogr* 36:127-162; and Griffin et al. (1993) *Appl Biochem Biotechnol* 38:147-159). It will be evident to one skilled in the art that, for certain embodiments, the occurrence of only one, two or three of the nucleic acid bases need be determined in the sequencing reaction. For instance, A-track or the like, e.g., where only one nucleotide is detected, can be carried out.

Yet other sequencing methods are disclosed, e.g., in U.S. Pat. No. 5,580,732 entitled "Method of DNA sequencing employing a mixed DNA-polymer chain probe" and U.S. Pat. No. 5,571,676 entitled "Method for mismatch-directed in vitro DNA sequencing."

In some cases, the presence of a specific allele of a marker in DNA from a subject can be shown by restriction enzyme analysis. For example, a specific nucleotide polymorphism can result in a nucleotide sequence comprising a restriction site which is absent from the nucleotide sequence of another allelic variant.

In a further embodiment, protection from cleavage agents (such as a nuclease, hydroxylamine or osmium tetroxide and with piperidine) can be used to detect mismatched bases in RNA/RNA DNA/DNA, or RNA/DNA heteroduplexes (Myers, et al. (1985) *Science* 230:1242). In general, the technique of "mismatch cleavage" starts by providing heteroduplexes formed by hybridizing a control nucleic acid, which is optionally labeled, e.g., RNA or DNA, comprising a nucleotide sequence of a marker allelic variant with a sample nucleic acid, e.g., RNA or DNA, obtained from a tissue sample. The double-stranded duplexes are treated with an agent which cleaves single-stranded regions of the duplex such as duplexes formed based on basepair mismatches between the control and sample strands. For instance, RNA/DNA duplexes can be treated with RNase and DNA/DNA hybrids treated with S1 nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine whether the control and sample nucleic acids have an identical nucleotide sequence or in which nucleotides they are different. See, for example, Cotton et al (1988) *Proc. Natl. Acad Sci USA* 85:4397; Saleeba et al (1992) *Methods Enzymol.* 217:286-295. In a preferred embodiment, the control or sample nucleic acid is labeled for detection.

In another embodiment, an allelic variant can be identified by denaturing high-performance liquid chromatography (DHPLC) (Oefner and Underhill, (1995) *Am. J. Human Gen.* 57:Suppl. A266). DHPLC uses reverse-phase ion-pairing chromatography to detect the heteroduplexes that are generated during amplification of PCR fragments from individuals who are heterozygous at a particular nucleotide locus within that fragment (Oefner and Underhill (1995) *Am. J. Human Gen.* 57:Suppl. A266). In general, PCR products are produced using PCR primers flanking the DNA of interest. DHPLC analysis is carried out and the resulting chromatograms are analyzed to identify base pair alterations or deletions based on specific chromatographic profiles (see O'Donovan et al. (1998) *Genomics* 52:44-49).

In other embodiments, alterations in electrophoretic mobility are used to identify the type of marker allelic variant. For example, single strand conformation polymorphism (SSCP) may be used to detect differences in electrophoretic mobility between mutant and wild type nucleic acids (Orita et al. (1989) *Proc Natl. Acad. Sci. USA* 86:2766, see also Cotton (1993) *Mutat Res* 285:125-144; and Hayashi (1992) *Genet Anal Tech Appl* 9:73-79). Single-stranded DNA fragments of sample and control nucleic acids are denatured and allowed to renature. The secondary structure of single-stranded nucleic acids varies according to sequence and the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In another preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the identity of an allelic variant of a polymorphic region is obtained by analyzing the movement of a nucleic acid comprising the polymorphic region in polyacrylamide gels containing a gradient of denaturant is assayed using denaturing gradient gel electrophoresis (DGGE) (Myers et al (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing agent gradient to identify differences in the mobility of control and sample DNA (Rosenbaum and Reissner (1987) *Biophys Chem* 265: 1275).

Examples of techniques for detecting differences of at least one nucleotide between two nucleic acids include, but are not limited to, selective oligonucleotide hybridization, selective amplification, or selective primer extension. For example, oligonucleotide probes may be prepared in which the known polymorphic nucleotide is placed centrally (allele-specific probes) and then hybridized to target DNA under conditions which permit hybridization only if a perfect match is found (Saiki et al. (1986) *Nature* 324:163); Saiki et al (1989) *Proc. Natl. Acad. Sci. USA* 86:6230; and Wallace et al. (1979) *Nucl. Acids Res.* 6:3543). Such allele specific oligonucleotide hybridization techniques may be used for the simultaneous detection of several nucleotide changes in different polymorphic regions of marker. For example, oligonucleotides having nucleotide sequences of specific allelic variants are attached to a hybridizing membrane and this membrane is then hybridized with labeled sample nucleic acid. Analysis of the hybridization signal will then reveal the identity of the nucleotides of the sample nucleic acid.

Alternatively, allele specific amplification technology which depends on selective PCR amplification may be used in conjunction with the instant invention. Oligonucleotides used as primers for specific amplification may carry the allelic variant of interest in the center of the molecule (so that amplification depends on differential hybridization) (Gibbs et al (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238; Newton et al. (1989) *Nucl. Acids Res.* 17:2503). This technique is also termed "PROBE" for Probe Oligo Base Extension. In addition it may be desirable to introduce a novel restriction site in the region of the mutation to create cleavage-based detection (Gasparini et al (1992) *Mol. Cell. Probes* 6:1).

In another embodiment, identification of the allelic variant is carried out using an oligonucleotide ligation assay (OLA), as described, e.g., in U.S. Pat. No. 4,998,617 and in Landegren, U. et al., (1988) *Science* 241:1077-1080. The OLA protocol uses two oligonucleotides which are designed to be capable of hybridizing to abutting sequences of a single strand of a target. One of the oligonucleotides is linked to a separation marker, e.g., biotinylated, and the other is detectably labeled. If the precise complementary sequence is found in a target molecule, the oligonucleotides will hybridize such that their termini abut, and create a ligation substrate. Ligation then permits the labeled oligonucleotide to be recovered using avidin, or another biotin ligand. Nickerson, D. A. et al. have described a nucleic acid detection assay that combines attributes of PCR and OLA (Nickerson, D. A. et al., (1990) *Proc. Natl. Acad. Sci.* (U.S.A.) 87:8923-8927. In this method, PCR is used to achieve the exponential amplification of target DNA, which is then detected using OLA.

The invention further provides methods for detecting single nucleotide polymorphisms in a marker. Because single nucleotide polymorphisms constitute sites of variation flanked by regions of invariant sequence, their analysis requires no more than the determination of the identity of the single nucleotide present at the site of variation and it is unnecessary to determine a complete gene sequence for each subject. Several methods have been developed to facilitate the analysis of such single nucleotide polymorphisms.

In one embodiment, the single base polymorphism can be detected by using a specialized exonuclease-resistant nucleotide, as disclosed, e.g., in Mundy, C. R. (U.S. Pat. No. 4,656,127). According to the method, a primer complementary to the allelic sequence immediately 3' to the polymorphic site is permitted to hybridize to a target molecule obtained from a particular animal or human. If the polymorphic site on the target molecule contains a nucleotide that is complementary to the particular exonuclease-resistant nucleotide derivative present, then that derivative will be incorporated onto the end of the hybridized primer. Such incorporation renders the primer resistant to exonuclease, and thereby permits its detection. Since the identity of the exonuclease-resistant derivative of the sample is known, a finding that the primer has become resistant to exonucleases reveals that the nucleotide present in the polymorphic site of the target molecule was complementary to that of the nucleotide derivative used in the reaction. This method has the advantage that it does not require the determination of large amounts of extraneous sequence data.

In another embodiment of the invention, a solution-based method is used for determining the identity of the nucleotide of a polymorphic site (Cohen, D. et al French Patent 2,650, 840; PCT Appln. No. WO91/02087). As in the Mundy method of U.S. Pat. No. 4,656,127, a primer is employed that is complementary to allelic sequences immediately 3' to a polymorphic site. The method determines the identity of the nucleotide of that site using labeled dideoxynucleotide derivatives, which, if complementary to the nucleotide of the polymorphic site will become incorporated onto the terminus of the primer.

An alternative method, known as Genetic Bit Analysis or GBA™ is described by Goelet, P. et al. (PCT Appln. No. 92/15712). The method of Goelet, P. et al. uses mixtures of labeled terminators and a primer that is complementary to the sequence 3' to a polymorphic site. The labeled terminator that is incorporated is thus determined by, and complementary to, the nucleotide present in the polymorphic site of the target molecule being evaluated. In contrast to the method of Cohen et al. (French Patent 2,650,840; PCT Appln. No. WO91/ 02087) the method of Goelet, P. et al. is preferably a heterogeneous phase assay, in which the primer or the target molecule is immobilized to a solid phase.

Several primer-guided nucleotide incorporation procedures for assaying polymorphic sites in DNA have been described (Komher, J. S. et al., (1989) *Nucl. Acids. Res.* 17:7779-7784; Sokolov, B. P., (1990) *Nucl. Acids Res.* 18:3671; Syvanen, A.-C., et al., (1990) *Genomics* 8:684-692; Kuppuswamy, M. N. et al., (1991) *Proc. Natl. Acad. Sci.* (U.S.A.) 88:1143-1147; Prezant, T. R. et al., (1992) *Hum. Mutat.* 1:159-164; Ugozzoli, L. et al., (1992) *GATA* 9:107-112; Nyren, P. (1993) et al., *Anal. Biochem.* 208:171-175). These methods differ from GBA™ in that they all rely on the incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A. C., et al., (1993) *Amer. J. Hum. Genet.* 52:46-59).

For determining the identity of the allelic variant of a polymorphic region located in the coding region of a marker, yet other methods than those described above can be used. For example, identification of an allelic variant which encodes a mutated marker can be performed by using an antibody specifically recognizing the mutant protein in, e.g., immunohistochemistry or immunoprecipitation. Antibodies to wild-type marker or mutated forms of markers can be prepared according to methods known in the art.

Alternatively, one can also measure an activity of a marker, such as binding to a marker ligand. Binding assays are known in the art and involve, e.g., obtaining cells from a subject, and performing binding experiments with a labeled ligand, to determine whether binding to the mutated form of the protein differs from binding to the wild-type of the protein.

B. Pharmacogenomics

Agents or modulators which have a stimulatory or inhibitory effect on amount and/or activity of a marker of the invention can be administered to individuals to treat (prophylactically or therapeutically) cancer in the subject. In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the amount, structure, and/or activity of the invention in an individual can be determined to thereby select appropriate agent(s) for therapeutic or prophylactic treatment of the individual.

Pharmacogenomics deals with clinically significant variations in the response to drugs due to altered drug disposition and abnormal action in affected persons. See, e.g., Linder (1997) Clin. Chem. 43(2):254-266. In general, two types of pharmacogenetic conditions can be differentiated. Genetic conditions transmitted as a single factor altering the way drugs act on the body are referred to as "altered drug action." Genetic conditions transmitted as single factors altering the way the body acts on drugs are referred to as "altered drug metabolism". These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some subjects do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the amount, structure, and/or activity of a marker of the invention in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of amount, structure, and/or activity of a marker of the invention.

C. Monitoring Clinical Trials

Monitoring the influence of agents (e.g., drug compounds) on amount, structure, and/or activity of a marker of the invention can be applied not only in basic drug screening, but also in clinical trials. For example, the effectiveness of an agent to affect marker amount, structure, and/or activity can be monitored in clinical trials of subjects receiving treatment for cancer. In a preferred embodiment, the present invention provides a method for monitoring the effectiveness of treatment of a subject with an agent (e.g., an agonist, antagonist, peptidomimetic, protein, peptide, antibody, nucleic acid, antisense nucleic acid, ribozyme, small molecule, RNA interfering agent, or other drug candidate) comprising the steps of (i) obtaining a pre-administration sample from a subject prior to administration of the agent; (ii) detecting the amount, structure, and/or activity of one or more selected markers of the invention in the pre-administration sample; (iii) obtaining one or more post-administration samples from the subject; (iv) detecting the amount, structure, and/or activity of the marker(s) in the post-administration samples; (v) comparing the amount, structure, and/or activity of the marker(s) in the pre-administration sample with the amount, structure, and/or activity of the marker(s) in the post-administration sample or samples; and (vi) altering the administration of the agent to the subject accordingly. For example, increased administration of the agent can be desirable to increase amount and/or activity of the marker(s) to higher levels than detected, i.e., to increase the effectiveness of the agent. Alternatively, decreased administration of the agent can be desirable to decrease amount and/or activity of the marker(s) to lower levels than detected, i.e., to decrease the effectiveness of the agent.

EXAMPLES

This invention is further illustrated by the following examples which should not be construed as limiting. The contents of all references, figures, Sequence Listing, patents and published patent applications cited throughout this application are hereby incorporated by reference.

Example 1

A. Materials and Methods

Cell Lines and Primary Tumors. All the primary tumors were acquired from the Cooperative Human Tissue Network (CHTN, Philadelphia, Pa.) and Brigham and Women Hospital Tissue Bank (Boston, Mass.). All the cell lines were obtained from the American Type Culture Collection (ATCC, Manassas, Va.). The histology was confirmed. The characteristics of the cell lines and of the primary tumors are reported in Tables 4 and 5, respectively.

Array-CGH profiling on cDNA microarrays. Genomic DNAs from cell lines and primary tumors were extracted according to the manufacturer instructions (Gentra System Lie, Minneapolis, Minn.). Genomic DNA was fragmented and random-prime labeled according to published protocols (Pollack, J. R., et al. (1999a) *Nat Genet* 23, 41-46.) with modifications. For details, see Aguirre, A. J., et al. (2004) *Proc Natl Acad Sci USA* 101, 9067-72. Labeled DNAs were hybridized to either human cDNA microarrays or oligo microarrays. The cDNA microarrays contain 14,160 cDNA clones (Agilent Technologies, Human 1 clone set) with 13,281 mappable clones, for which approximately 11,211 unique map positions were defined (NCBI, Build 35). The median interval between mapped elements is 72.7 kilobase, 94.1% of intervals are less than 1 Mb, and 98.9% are less than 3 Mb. The oligo array contains 22K oligonucleotides (Agilent Technologies). All probes were subjected to BLAST alignment with the latest draft of human/mouse genome sequence (NCBI, Build 35). Based on the BLAST results, un-mappable probes were eliminated, which were arbitrarily defined as alignment length of best hit less than 55 bp; and un-informative probes, which were identified by having a second best hit score of 95% or higher on the alignment length of the best hit. These criteria selected 16022 informative probes for the human array. The median interval between mapped elements is 54.7 kilobase, 96.7% of intervals are less than 1 Mb, and 99.5% are less than 3 Mb.

Fluorescence ratios of scanned images of the arrays were calculated and the raw array-CGH profiles were processed to identify statistically significant transitions in copy number using a segmentation algorithm which employs permutation to determine the significance of change points in the raw data (Olshen, A. B., et al. (2004) *Biostatistics* 5(4):557-72). Each segment is assigned a $Log_2$ ratio that is the median of the contained probes. The data is centered by the tallest mode in the distribution of the segmented values. After mode-centering, gains and losses were defined as $Log_2$ ratios of greater than or equal to +0.11 or −0.11 (+/−4 standard deviations of the middle 50% quantile of data), and amplification and deletion as a ratio greater than 0.4 or less than −0.4, respectively. For the cDNA dataset, gains and losses were defined as $Log_2$ ratios of greater than or equal to +0.13 or −0.13 (+/−4 standard deviations of the middle 50% quantile of data), and amplification and deletion as a ratio greater than 0.55 or less than −0.5, respectively. The permutation test to compare the squamous cell carcinoma and the adenocarcinoma oncogenomes was performed as follows. The segmented array CGH data were divided into squamous cell carcinoma and the adenocarcinoma groups. Thresholds 0.1 (over) and −0.1 (under) were used for obtaining genome changes. At each probe, all samples exceeding the thresholds were counted for the squamous cell carcinoma and the adenocarcinoma groups, respectively. The scores were then calculated as following:

score.over=(squamous.over−adeno.over)$^2$/(squamous.over+adeno.over)

score.under=(squamous.under−adeno.under)$^2$/(squamous.under+adeno.under)

The permutations were performed 1000 times by scrambling sample group labels. The scores were calculated as above and the peak score for all probes was maintained for each permutation. The statistically significant probes were identified by comparing the score among 1000 peak scores from permutation testing with a 5% false positive rate as the cut off.

The comparison between amplificatioii/deletion in squamous and adenocarcinomas was performed as follows. A custom-made algorithm was designed to identify all the probes, on the segmented data, that were above a $Log_2$ ratio of 0.6 in at least 15% of the samples in one tumor subtype and absent in the other dataset. For the deletions, the algorithm searched for all the probes on the segmented data that were below a $Log_2$ ratio of −0.6 in at least 15% of the samples in one tumor subtype and absent in the other dataset.

Automated locus definition. Minimal Common Regions (MCRs) were defined by an automated algorithm applied to the segmented data based on the following rules:

1. Segments above 0.4 or below −0.4 (0.5 and 0.55 for cDNA) are identified as altered.

2. If two or more altered segments are adjacent in a single profile or separated by less than 500 KB, the entire region spanned by the segments is considered to be an altered span.

3. Highly altered segments or spans that are shorter than 20 MB are retained as "informative spans" for defining discrete locus boundaries. Longer regions are not discarded, but are not included in defining locus boundaries.

4. Informative spans are compared across samples to identify overlapping groups of positive-value or negative-value segments; each group is called an "overlap group".

5. Overlap groups are divided into separate groups wherever the recurrence rate falls below 25% of the peak recurrence for the whole group. Overlap groups are divided into separate groups wherever the recurrence rate falls below 25% of the peak recurrence for the whole group. Recurrence is calculated by counting the number of samples with alteration at high threshold (0.4, −0.4).

6. Minimal common regions (MCRs) are defined as contiguous spans having at least 75% of the peak recurrence. If two MCRs are separated by a gap of only one probe position, they are joined. If there are more than 3 MCRs in a locus, the whole region is reported as a single complex MCR.

MCR Characterization. For each MCR, the peak segment value is identified. Recurrence of gain or loss is calculated across all samples based on the lower thresholds previously defined (~+/−0.11). As an additional measure of recurrence independent of thresholds for segment value or length, Median Aberration (MA) is calculated for each probe position by taking the median of all segment values above zero for amplified regions, below zero for deleted regions. This pair of values is compared to the distribution of values obtained after permuting the probe labels independently in each sample profile. Where the magnitude of the MA exceeds 95% of the permuted averages, the region is marked as significantly gained or lost, and this is used in the voting system for prioritization. The number of known genes is counted based on the July 2003 human assembly at NCBI (build 35).

Complexity analysis. The change-point statistical model used for copy number inference data (Olshen, A. B., et al. (2004) *Biostatistics* 5(4):557-72) defines a contiguous genomic region of uniform copy number as a segment: each segment contains a copy number different from its neighboring segments and so transitions between adjacent segments delineate transition in copy number. The number of segments and the size of these segments are indicators of frequency of copy number alterations across the genome. Only segments above or below 0.4 were considered in this analysis.

Sequencing. Primers for PCR amplification and sequencing of the FGFR1 tyrosine kinase domain (Celera accession hCT1964964, exons 12-18) were designed as previously described (Bardelli, A., et al. (2003) *Science* 300, 94.). Forward and reverse sequences of PCR-amplified exons were acquired from the six primary lung tumors and the two lung cancer cell lines harboring the 8p11 genomic amplification. Chromatograms were assembled using Sequencher (Gene Codes Corporation, Ann Arbor, Mich.) and manually compared to the NCBI reference sequence for FGFR1 for identification of possible mutations (see Table 6).

Quantitative PCR (QPCR) verification. PCR primers were designed to amplify products of 100-150 bp within target and control sequences (see Table 6). Primers for control sequences in each cell line were designed within a region of euploid copy number as shown by array-CGH analysis. Quantitative PCR was performed, by monitoring in real-time, the increase in fluorescence of SYBR Green dye (Qiagen, Valencia, Calif.) with an ABI 7700 sequence detection system (Perkin Elmer Life Sciences, Boston, Mass.). Relative gene copy number was calculated by the standard curve method (Ginzinger, D. G. (2002) *Exp Hematol* 30, 503-512). Estimates of gene dosage were made relative to the most common copy number within a sample. For PCR validation, abundant Line elements were used as a reference against which to compare copy number alterations. Based on previous experience with other datasets (Aguirre, A. J., et al. (2004) *Proc Natl Acad Sci USA* 101, 9067-9072; Brennan, C., et al. (2004) *Cancer Res* 64, 4744-4748), a threshold of 2 (as relative gene dosage) was used as a cutoff of alteration. For validation of expression, RNA-specific PCR primers were designed to amplify products of 100-150 bp across exons (see Table 6). As reference, normal lung RNA was used (Ambion, Austin, Tex.).

Expression Profiling on Affymetrix GeneChip. Biotinylated target cRNA was generated from total sample RNA and hybridized to human oligonucleotide probe arrays (U133Plus 2.0, Affymetrix, Santa Clara, Calif.) according to standard protocols (Golub, T. R., et al. (1999) *Science* 286, 531-537). Expression values were normalized in dChip (Li, C., and Wong, W. H. (2001) *Proc Natl Acad Sci USA* 98, 31-36) and then for each gene were standardized by $Log_2$ ratio to the median of the cohort. Twenty-eight cell lines, twenty-nine tumors, as well as normal tissue adjacent to tumor tissue were analyzed on these oligo arrays.

Integrated copy number and expression analysis. Array-CGH data was interpolated such that each expression value can be mapped to its corresponding copy number value. For each gene position, the samples were grouped based on whether array-CGH showed altered copy number or not based on interpolated CGH value. The effect of gene dosage on expression was measured by calculating a gene weight defined as the difference of the means of the expression value in the altered and unaltered sample groups divided by the sum of the standard deviations of the expression values in altered and unaltered sample groups (Aguirre, A. J., et al. (2004) *Proc Natl Acad Sci USA* 101, 9067-9072; Hyman, E., et al (2002) *Cancer Res* 62, 6240-6245). The significance of the weight for each gene was estimated by permuting the sample labels 10,000 times and applying an alpha threshold of 0.05.

Fluorescence in situ hybridization (FISH). Metaphase spread slides were prepared following standard protocols (Protopopov, A. I., et al. (1996) *Chromosome Res* 4, 443-447). Frozen tissue sections (4 μm) were pre-treated according to manufacturer's protocol (Frozen Tissue Prep for FISH, Vysis, Downers Grove, Ill.). The BACs RP11-138J2 (at 27 MB, CHR 8), RP11-265K5 (from HTPAP to LETM2 on CHR 8; BAC #1), RP11-100B16 (covering FGFR1 and FLJ43582 on CHR 8; BAC#2) and RP11-90P5 (covering from LSM1 to DDHD2 on CHR 8; BAC#3) were used for the hybridizations. The probes for the FISH analysis were labeled using nick translation, according to the manufacturer's instructions (Roche Molecular Biochemicals, Indianapolis, Ind.) with either biotin-14-dATP or digoxigenin-11-dUTP. Biotinylated probes were detected using Cy3-conjugated avidin (Accurate Chemical, Westbury, N.Y.). For digoxigenin-labeled probes, antidigoxigenin-FITC Fab fragments (Enzo Life Sciences, Farmingdale, N.Y.) was used. Slides were counterstained with 5 μg/ml 4',6-diamidino-2-phenylindole (Merck, Wilmington, Del.) and mounted in Vectashield antifade medium (Vector Laboratories, Burlingame, Calif.). FISH signals acquisition and spectral analysis was performed using filter sets and software developed by Applied Spectral Imaging (Carlsbad, Calif.).

B. Results

Lung cancer is the leading cause of cancer related mortality in the United States, accounting for more than one-fourth of all cancer fatalities in 2004. Distinctive clinical and pathobiological features serve to classify lung cancers into two major subtypes: small cell lung cancer (SCLC) and non-small cell lung cancer (NSCLC). NSCLC constitutes 75% of lung cancer cases and is subdivided further into three major histologically distinct subtypes including adenocarcinoma, squamous cell carcinoma and large cell carcinoma. Adenocarcinoma and squamous carcinoma subtypes represent over 85% of NSCLC cases. While these NSCLC subtypes exhibit distinct clinical and pathological characteristics, the treatment approaches have remained generic and largely ineffective despite advances in cytotoxic drugs, radiotherapy, and clinical management. The cure rate for advanced NSCLC cancer remains among the most dismal in oncology. For all stages of NSCLC, the 5-year survival rate has remained fixed at 15% for the last 15 years. The recent success of molecularly targeted therapies for a limited number of cases with specific cancer genotypes (Lynch, T. J., et al. (2004). *N Engl J Med* 350, 2129-2139; Paez, J. G., et al. (2004) *Science* 304, 1497-1500) has solidified the view that a more detailed knowledge of the spectrum of genetic lesions in lung cancer will in turn lead to meaningful therapeutic progress.

To date, the majority of lung cancer genetic studies have cataloged mutations or promoter methylation status of known cancer genes, performed genome-wide loss-of-heterozygosity surveys, and applied CGH to audit regional copy number alterations (CNAs) on metaphase chromosomes or small-scale BAC arrays. These concerted efforts have identified a core set of lesions including K-RAS activation mutations and loss-of-function mutations in the p53 and Rb pathways (Minna, J. D., et al (2002) *Cancer Cell* 1, 49-52). At the same time, the observed high number of recurrent chromosomal aberrations, particularly amplifications and deletions, belies that only a small fraction of the lung cancer genes has been identified to date.

Integrated CGH and expression profiling have emerged as a highly effective approach to cancer gene discovery, capable of providing a genome-wide view of the regional gains and losses throughout the cancer genome (Kallioniemi, O. P., et al. (1994) *Genes Chromosomes Cancer* 10, 231-243) and associated copy number-driven changes in gene expression (Aguirre, A. J., et al. (2004) *Proc Natl Acad Sci USA* 101, 9067-9072; Pollack, J. R., et al. (1999b) *Nat Genet.* 23, 41-46; Pollack, J. R., et al (2002) *Proc Natl Acad Sci USA* 99, 12963-12968). In the case of NSCLC, chromosomal CGH studies have revealed recurrent gains at 1q31, 3q25-27, 5p13-14 and 8q23-24 and deletions at 3p21, 8p22, 9p21-22, 13q22, and 17p12-13 (Balsara, B. R., and Testa, J. R. (2002) *Oncogene* 21, 6877-6883; Bjorkqvist, A. M., et al (1998) *Br J Cancer* 77, 260-269; Luk, C., et al. (2001) *Cancer Genet Cytogenet* 125, 87-99; Pei, J., et al. (2001) *Genes Chromosomes Cancer* 31, 282-287; Petersen, I., et al. (1997) *Cancer Res* 57, 2331-2335). A recent limited array CGH survey of known genes/loci possibly contributing to lung cancer has demonstrated the utility of this approach by confirming recurrent chromosome 3p deletions and 3q gains, and identified PIK3CA as a resident of chromosome 3q amplicon (Massion, P. P., et al. (2002) *Cancer Res* 62, 3636-3640), a gene shown subsequently to harbor activating point mutations in some lung cancer cases (Samuels, Y., et al. (2004) *Science* 304 554).

In the microarray format, the resolution of CGH is dictated by the number and quality of mapped probes positioned along the genome (Albertson, D. G., and Pinkel, D. (2003) *Hum Mol Genet.* 12, 145R-152). As described herein, high-density cDNA- and oligonucleotide-based arrays were used to conduct high-resolution surveys of CNAs present in a well-defined collection of primary adenocarcinomas and squamous cell carcinomas and in a panel of established NSCLC cell lines. The application of novel custom bioinformatics tools, along with integration of expression profiles and public databases, has yielded a dramatic increase in the number of recurrent amplifications and deletions detectable in the NSCLC genome. The high degree of NSCLC genomic complexity, the recurrent nature of these lesions, and preliminary functional characterization of resident genes points to a large number of relevant oncogenic events, creating therapeutic and diagnostic compositions of matter and methods of using the same.
Identification of Known and Novel CNAs in the NSCLC Genome.

Figure 7:
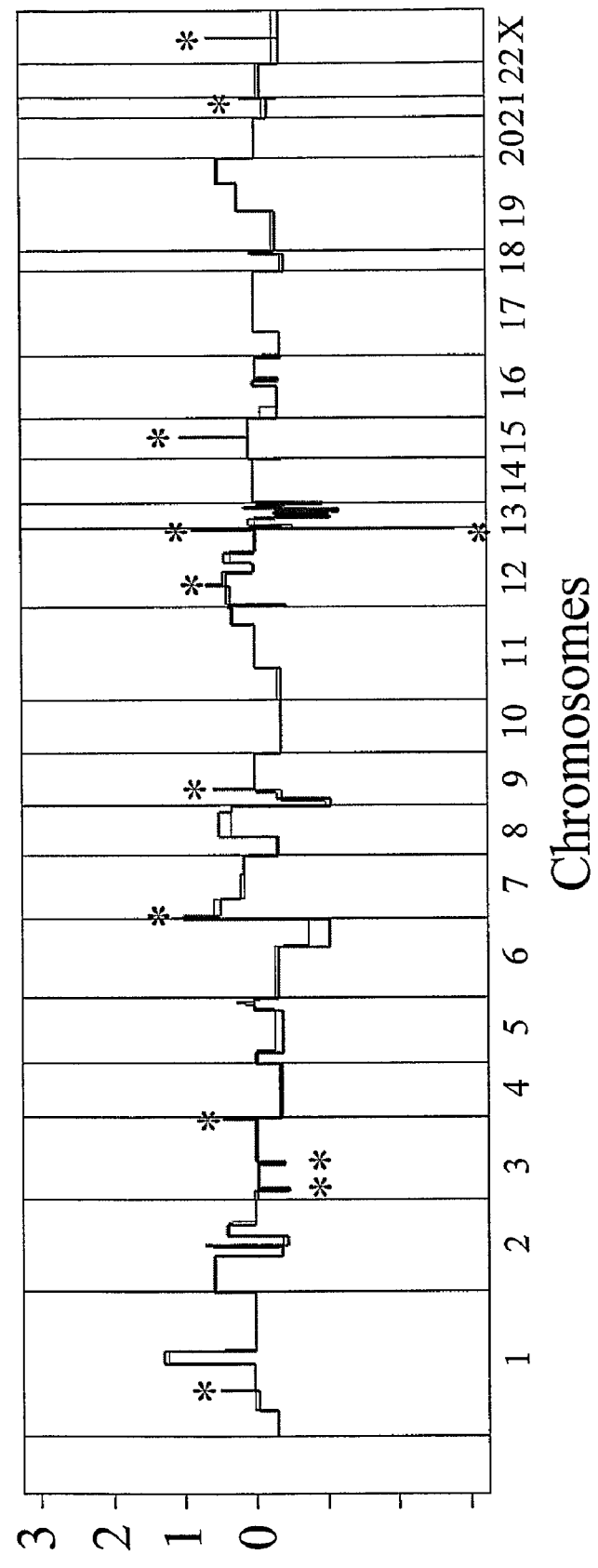
FIG. 7 depicts the high level of concordance between the cDNA and oligo-aCGH profiles. A representative example is shown contrasting cDNA- and oligo-aCGH profiles for the adenocarcinoma cell line NCI-H1623. The profiles are depicted in light gray (cDNA-aCGH) and dark gray (oligo-aCGH) The higher resolution of the oligonucleotide array platform relative to cDNA arrays uncovered several additional highly focal CNAs (asterisks).

Forty-five tumors, frozen at the time of the initial resection and verified to be adenocarcinomas (n=19) or squamous cell carcinomas (n=26) and possessing greater than 70% tumor cellularity were subjected to genome-wide CGH profiling (Table 4). In addition to the primary tumors, CGH and expression profiling was performed on a panel of 34 NSCLC cell lines (Table 5). All primary tumors and 14 NSCLC cell lines were analyzed using an oligonucleotide array platform with a median resolution of 50 kB (Brennan, C., et al. (2004) *Cancer Res* 64, 4744-4748), and the remaining 20 NSCLC cell lines were interrogated using a cDNA array platform with a median resolution of 100 kB (Aguirre, A. J., et al. (2004) *Proc Natl Acad Sci USA* 101, 9067-9072). Eleven cell lines were analyzed by both platforms, revealing a high level of concordance between the two datasets (correlation coefficient between 0.88-0.95). Additionally, as previously demonstrated (Brennan, C., et al. (2004) *Cancer Res* 64, 4744-4748), the higher resolution of the oligonucleotide array platform relative to cDNA arrays uncovered several additional highly focal CNAs and greater structural detail of each CNA (FIG. 7).

To identify copy number changes above noise background, a modified version of the circular binary segmentation methodology as described previously was applied (Aguirre, A. J., et al. (2004) *Proc Natl Acad Sci USA* 101, 9067-9072; Olshen, A. B., et al. (2004) *Biostatistics* 5, 557-572) (see also Materials and Methods). The most striking feature of the NSCLC dataset was the large number of CNAs (n=334) which, along with the high degree of structural complexity for each CNA, prompted filtering of the dataset through an algorithm proven effective in defining and prioritizing CNAs across large highly complex array-CGH datasets (Aguirre, A. J., et al. (2004) *Proc Natl Acad Sci USA* 101, 9067-9072).

This algorithm applies several criteria including (i) recurrence of high-threshold amplification or deletion (above the 97th percentile or below the 3rd percentile) in at least two specimens, (ii) presence of a high threshold event in at least one primary tumor specimen, (iii) statistically significant median aberration, and (iv) a peak intensity equal to or greater than absolute $Log_2$ value of 0.8 in either a cell line or primary tumor (i.e., beyond 0.5% quintiles). From a collection of 334 CNAs, this algorithm yielded 126 so-called 'high-confidence' Minimal Common Regions (MCRs) that satisfied at least three of the four criteria (Table 7). Ninety-one of these MCRs were amplifications and 35 were deletions. Although the median size of the 126 high-confidence MCRs defined automatically by the algorithm was calculated to be 1.42 Mb, 23% (29) of these MCRs spanned 0.5 Mb or less with a median of 4 genes (Table 7; Table 7 shows high-confidence MCRs in lung adenocarcinoma and squamous cell carcinoma, spanning less than 1 MB). The numbers of primary tumors (T) or cell lines (C) with gain or loss, and amplification or deletion, are listed, respectively. The MCR at 11q11 has recently been shown by Sebat et al. (Sebat, et al. (2004) *Science* 305:525) to be a copy number polymorphism (ORF511, chromosome 11q11). Moreover, given that the parameters used by the automated MCR definition program are relatively conservative and the fact that not all genes are represented by probes on these microarrays, real-time QPCR measurement of gene dosage and FISH analysis can further refine and narrow the boundaries of an MCR, as illustrated by the 8p12-p11.2 amplicon (Table 7 and FIG. 4), thereby presenting a large number of loci with a highly tractable number of candidate cancer genes for further analysis.

Figure 2:
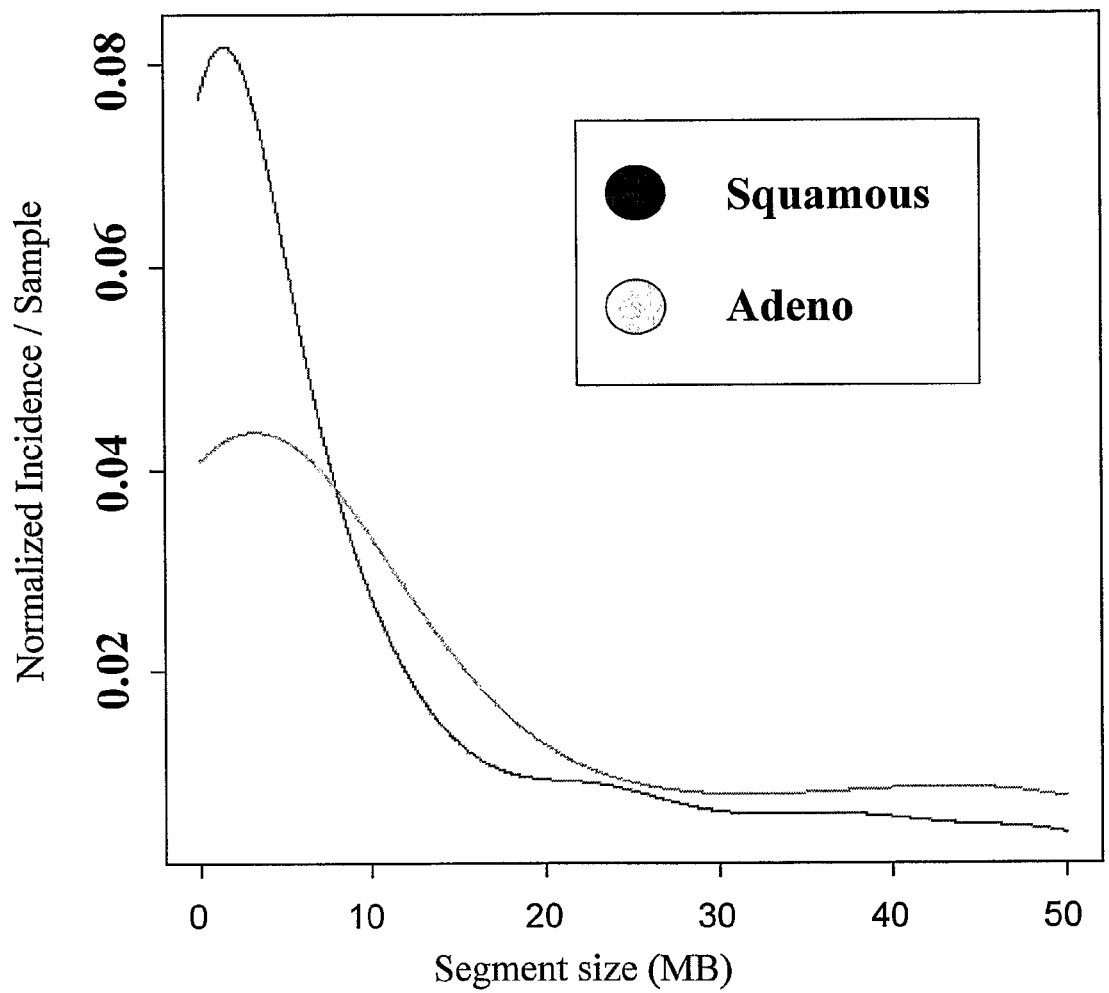
FIG. 2 depicts the chromosomal segment length distribution. Overall level of genomic complexity was estimated for adenocarcinoma and squamous cell carcinoma aCGH profiles by quantifying the number of narrow, high amplitude copy number alterations in each set. Within the two sample classes, each profile was reviewed for highly altered regions of the genome (segments showing absolute $\log_2$ copy number >0.4, see the Materials and Methods section). These were plotted in a histogram according to the length of the region, in megabases. The area under the curves is normalized to the overall incidence of high-level alteration per sample in the adenocarcinoma and squamouscell carcinoma datasets.

On first analysis, the dataset contained all the regional gains and losses previously identified in NSCLC by chromosomal CGH and conventional genomic methodologies including the known gains at 1q31, 3q25-27, 5p13-14, and 8q23-24 as well as the known deletions at 3p, 8p22, 9p21-22, 13q22, and 17p12-13 (FIG. 1). Furthermore, virtually all of the genes implicated in the pathogenesis of NSCLC were contained within the high-confidence MCRs including $p16^{INK4A}$ and RB1 tumor suppressor genes, and MYC, EGFR and KRAS2 oncogenes (Table 7). The whole short arm of chromosome 3 was consistently lost, with a peak recurrence at around 50 MB (29 out of 79 samples, 36%). Segmentation did not identify obvious homozygous deletions which would point to a specific target in this recurrently lost region of 3p, however this region contains RASSF1, TUSC2, SEMA3B and FHIT, genes that have been previously shown to have LOH in NSCLC (Balsara and Testa, (2002 *Oncogene* 21:6877) (FIG. 1 and FIG. 8). The confidence level ascribed to these 126 selected MCRs was further supported by verification with real-time QPCR on 17 randomly selected MCRs.
Common and Disease-Specific Genomic Features Primary NSCLC consists of two major subtypes, the squamous cell carcinoma and the adenocarcinoma subtypes. A comparison of overall copy number variation for high-intensity events across the genomes of these two subtypes revealed a higher degree of genomic complexity in the squamous cell carcinoma subtype (FIG. 2). Additionally, further analysis revealed that squamous carcinoma samples harbor more complex rearrangements with multiple short segments linked together when compared to the adenocarcinoma subset.

However, despite this qualitative difference in their genomic profiles, the most remarkable aspect of the subtype comparison was the significant overlap of CNAs between the two primary tumor datasets, including gains/amplifications at 1q, 5p, and 20q and losses/deletions at 3p and 9p. To identify recurrent gained/amplified or lost/deleted regions that were distinct for each histological dataset, the incidence of events in each primary tumor group were compared and significance estimated by permutation testing (see Materials and Methods). Strikingly, these two groups presented very few unique changes compared to within-group variation. In particular, two regions on the long arm of chromosome 3, from 3q11.2 to 3q13.2 and from 3q26.3 to 3q29, were selectively gained and/or amplified in lung squamous cell carcinoma. These findings are in agreement with previous reports showing that the only genomic region consistently differentiating squamous cell carcinomas versus adenocarcinoma is a gain/amplification of the telomeric part of chromosome 3q in squamous carcinoma (Balsara and Testa, 2002; Bjorkqvist et al., 1998; Luk et al., 2001; Pei et al., 2001; Petersen et al., 1997). In addition, gains/amplifications on the long arm of chromosome 22, from 22q11 to 22q12.2 were selectively present in lung squamous cell carcinoma, a region not previously implicated. The analysis did not reveal any genomic regions of loss or deletion that could differentiate the lung squamous cell carcinoma from adenocarcinoma in the present dataset. In addition, the analysis did not identify any genomic regions that were unique for the lung adenocarcinoma.

Figure 3:
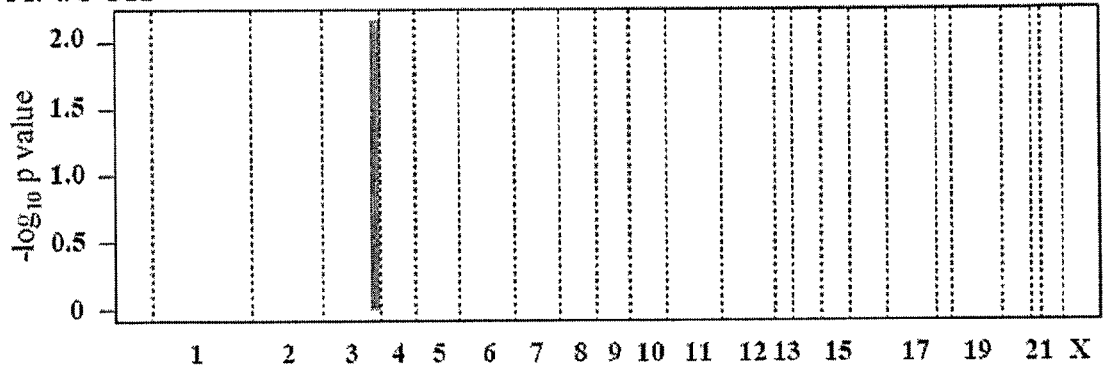
FIG. 3 show that Chromosome 3q, from 180 MB to 199 MB, is the only genomic region that shows significantly difference between AC and SCC by both aCGH and expression profiling. On both plots, x-axis coordinates represent probes ordered by genomic map positions, from chromosome 1 to chromosome X. (A) Probes significantly gained/amplified comparing SCC and AC primary tumors, on array-CGH. Y-axis represents the $-\log_{10}$ P value of the permutation test. Probes presenting a P<0.05 are plotted in red, probes with a P>0.05 in gray. No probes were significantly lost/deleted after comparison between SCCs and ACs primary tumors. (B) Genomic regions significantly enriched for differentially expressed probes comparing SCC and AC primary tumors. Y-axis represents the $-\log_{10}$ adjusted p values of Fisher's exact test for enrichment. Red lines highlight regions with an adjusted P<0.05 adjusted for multiple testing, probes with an adjusted P>0.05 are in gray.
Figure 3:
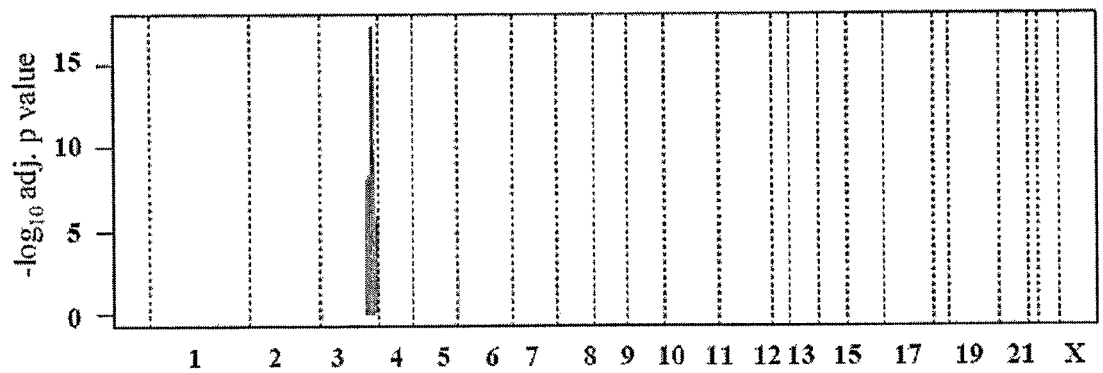

Given the remarkable similarity between the patterns of CNAs in the two cell types, it was determined what part of the difference in expression profiling reported between squamous cell carcinoma and adenocarcinoma was related to genes residing within chromosome 3q and 22q. Using a t-test, probes that most significantly differentiated the two histological subgroups in the expression profiling datasets were identified. The probes corresponding to genes previously reported as able to differentiate lung squamous cell carcinoma from adenocarcinoma were included, including p63, several members of the keratin family, collagen type VII, α 1 and desmoglein 3 (Bhattacharjee, A., et al. (2001) *Proc Natl Acad Sci USA* 98, 13790-13795; Garber, M. E., et al. (2001) *Proc Natl Acad Sci USA* 98, 13784-13789). Most of the genes that significantly differentiated squamous cell carcinoma from adenocarcinoma showed sharp upregulation in the squamous cell carcinomas and no change or modest downregulation in the adenocarcinomas. When the probes that showed a significant difference between the two subsets were mapped to their genomic position, only two chromosomal arms, the long arms of chromosome 3 and 22 showed a statistically significant enrichment in mapped probes, compared to that expected by chance alone. The same analysis was performed with another recently published lung cancer expression profiling dataset (Bhattacharjee, A., et al. (2001) *Proc Natl Acad Sci USA* 98, 13790-13795). Only chromosome 3q, but not 22q, showed a statistically significant enrichment in the number of probes that were overexpressed in lung squamous cell carcinoma as compared to the adenocarcinomas. These findings suggest that genes residing within 3q and possibly 22q often show copy-number driven expression in squamous cell carcinomas. Gains/amplification of 3q is an event that is frequent, but not always present in squamous cell carcinomas, both in the present dataset, where it was present in 54% of the samples, as well as in the literature (where the reported frequencies are between 50 and 85% of the cases) (Balsara, B. R., and Testa, J. R. (2002) *Oncogene* 21, 6877-6883; Bjorkqvist, A. M., et al. (1998) *Genes Chromosomes Cancer* 22, 79-82; Luk, C., et al. (2001) *Cancer Genet Cytogenet* 125, 87-99; Pei, J., et al (2001) *Genes Chromosomes Cancer* 31, 282-287; Petersen, I., et al. (1997) *Cancer Res* 57, 2331-2335). Therefore, it was determined that squamous cell carcinomas without 3q gains/amplification nevertheless showed overexpression of genes mapping to 3q. When additive tree-based dendrograms were generated using only the genes located on 3q, most of the squamous samples clustered together, irrespectively of the presence or absence of gains of 3q (FIG. 3). These findings suggest that gene dosage amplification or transcriptional deregulation of one or, more likely, several genes present in 3q is important in driving the cellular squamous phenotype. Interestingly, using this selected population of 3q and 22q genes, three squamous cell carcinoma samples, S1, S5 and S14, did not cluster together with the other squamous cell carcinoma samples in both 3q and 22q dendrograms (FIG. 3), but rather clustered the adenocarcinomas, suggesting that there is at least one different pathway driving the squamous cell carcinoma phenotype in a subgroup of squamous cell carcinomas, not related to genes residing in 3q or 22q.

Because oncogenes are usually associated with high-level amplifications and tumor suppression genes are often defined by narrow homozygous deletions, the presence of high-intensity events, it was determined whether these events were selectively present in one dataset but not in the other. All the amplifications and deletions present in 15% or more of the adenocarcinoma samples were present in at least one of the squamous call carcinoma samples except for the amplification on the long arm of chromosome 8. Conversely, with two exceptions (see below), all of the recurrent (>15%) squamous cell carcinoma amplifications and deletions were present in the adenocarcinoma tumors, again suggesting the high degree of similarity between squamous cell carcinoma and adenocarcinomas even for high-intensity events.

As noted above, there were two highly recurrent (>15%) amplifications that were found to be present only in the squamous cell carcinoma dataset, presenting the possibility of uncovering subtype-specific CNAs of pathobiological importance. The first region mapped to the long arm of chromosome 3 (3q26-3qter). The second squamous cell carcinoma-specific amplicon located at 8p12-p11.2 was a novel amplicon and was subjected to detailed structural analysis.

Common and Distinct Genomic Features in AC and SCC

Previous analyses of the NSCLC genome using low-resolution chromosomal or BAC array CGH have consistently shown that the only region of the genome differentiating SCCs from ACs was 3q26-q29 (Bjorkqvist, A. et al. (1998) *Genes Chromosomes Cancer* 22, 79-82; Luk, C. et al. (2001) *Cancer Genet Cytogenet* 125, 87-99; Pei, J. et al. (2001) *Genes Chromosomes Cancer* 31, 282-7; Petersen, I. et al. (1997) *Cancer Res* 57, 2331-5; Balsara, B. R. & Testa, J. R. (2002) *Oncogene* 21, 6877-83). With this higher-resolution platform capable of detecting previously unrecognized focal CNAs (see above), it was sought to determine whether there exist additional genomic events that are characteristic of either SCC or AC. Surprisingly, the genomic profiles of AC and SCC were highly overlapping such that neither supervised nor unsupervised clustering of the global CGH profiles was able to classify these tumors according to their histopathological subtypes (FIG. 1 and data not shown). Next, it was asked whether there are significant regional differences between AC and SCC subtypes. To this end, a permutation test was designed to compare the incidence of events in each primary tumor subtypes and to estimate the significance (see Materials and Methods). This permutation test identified only one region of gain/amplification on the long arm of chromosome 3, from 180 Mb to 199 Mb, corresponding to 3q26 to 3q29, that was significantly targeted in the SSCs (FIG. 3a). Therefore, despite strikingly distinct histological presentations, SCC and AC are remarkably similar on the genomic level and are likely driven by many of the same oncogenes and tumor suppressor gene mutations.

It was further hypothesized that the defined MCR on 3q harbors gene(s) driving the SCC phenotype and such resident target(s) can be up-regulated by mechanisms other than gene amplification since, although common among SCC, gain/amplification of 3q from 180-199 Mb is not present in all cases of SCC (54% in our samples and between 50 and 85% in the literature (Bjorkqvist, A. et al. (1998) *Genes Chromosomes Cancer* 22, 79-82; Luk, C. et al. (2001) *Cancer Genet Cytogenet* 125, 87-99; Pei, J. et al. (2001) *Genes Chromosomes Cancer* 31, 282-7; Petersen, I. et al. (1997) *Cancer Res* 57, 2331-5; Balsara, B. R. & Testa, J. R. (2002) *Oncogene* 21, 6877-83). Thus, by comparing expression patterns of probes residing within 3q180-199 Mb region, would be identified genes that are consistently overexpressed in SCC versus AC regardless of copy number status and such genes might have a higher probability to play a critical in driving SCC phenotype. To this end, a one-way ANOVA and a post-hoc Bonferroni test using all the probes (n=166, corresponding to 106 genes) residing within the 180 to 199 Mb boundaries on 3q (see Material and Methods) identified a subset of genes showing significant overexpression in SCCs versus ACs, and were overexpressed even in the absence of gene copy number gains on 3q in SCCs: p63, Claudin 1, Phosphatidylinositol glycan, class X, and discs large homolog 1 (Table 8). The p63 gene is most notable given its seminal role in squamous tissue development and its links to squamous cancer subtypes (McKeon, F. (2004) *Genes Dev* 18, 465-9; Massion, P. P. et al. (2003) *Cancer Res* 63, 7113-21; Westfall, M. D. & Pietenpol, J. A. (2004) *Carcinogenesis* 25, 857-64; Koster, M. I. et al. (2004) *Genes Dev* 18, 126-31).

To further corroborate the above finding, the global expression profile data was analyzed for the same NSCLC samples using SAM (Significant Analysis for Microarray Data, (Tusher, V. G., Tibshirani, R. & Chu, G. (2001) *Proc Natl Acad Sci USA* 98, 5116-21)). A total of 297 probes were found to be significantly different between SCCs and ACs, based on a q-value (false discovery rate, FDR) cutoff of 0.05 (Storey, J. D. & Tibshirani, R. (2003) *Proc Natl Acad Sci USA* 100, 9440-5). Of this list of differentially expressed genes, it was whether their differential expressions was driven by underlying copy number events. To this end, all of the 297 differentially expressed probes were mapped to their corresponding genomic positions and, using a 10 Mb moving window analysis across the genome and then applying a Fisher's exact test (see Materials and Methods), those genomic regions that were significantly enriched for differentially expressed probes were identified. As shown in FIG. 3b, this global analysis again identified 3q 180-199 MB as the genomic region whose resident genes are most significantly enriched for among the list of differentially expressed genes between AC and SCC. Similar results were also obtained when a published lung cancer expression profile dataset was utilized (Bhattacharjee, A. et al. (2001) *Proc Natl Acad Sci USA* 98, 13790-5) (data not shown). In conclusion, the integrated aCGH and expression analyses strongly implicate a limited number of genes residing within 3q as key drivers of SCC histopathological phenotype.

Characterization of Squamous Cell Carcinoma Subtype Specific Amplicon on 8p12-p11.2

The limited resolution of the microarrays and the conservative parameters of the automated algorithm in defining MCRs prompted a detailed mapping of the 8p12-p11.2 amplicon by real-time QPCR to better define the event boundaries. Primer pairs were designed for genes residing around and within the putative amplicon and the corresponding gene dosages were determined by QPCR in multiple primary tumor and cell line samples (FIG. 4A). Based on two informative primary tumor cases, PT3 and PT5, this analysis defined the MCR as 0.14 MB in size and containing 2 annotated genes (FIG. 4A).

As shown in FIG. 4A, QPCR analysis clearly positioned the FGFR1 gene outside of the telomeric boundary of this MCR. Since FGFR1 has been considered to be a prime candidate for this 8p amplicon in other cancer types (Edwards, J., et al. (2003) *Clin Cancer Res* 9, 5271-5281; Mao, X., et al. (2003) *J Invest Dermatol* 121, 618-627; Simon, R., et al. (2001) *Cancer Res* 61, 4514-4519), interphase fluorescence in situ hybridization (FISH) was conducted to verify the definition of this boundary. Using BAC #1 (spanning part of the amplicon and not including FGFR1) as a probe, FISH analysis of all 8 samples (two cell lines and six primary tumors) confirmed the presence of a high-copy number amplicon at 8p12-p11.2 (FIGS. 4A-F, FIGS. 9-11). Consistent with the QPCR data, FISH analysis with BAC #2 (outside of the MCR and including FGFR1) on PT3 revealed only two copies (FIGS. 4A and 4D), proving unequivocally that FGFR1 is not amplified in this sample. FISH analysis with BAC #3 defined the telomeric boundaries in PT5, again in accordance with aCGH and QPCR data (FIGS. 4E and F).

Figure 5:
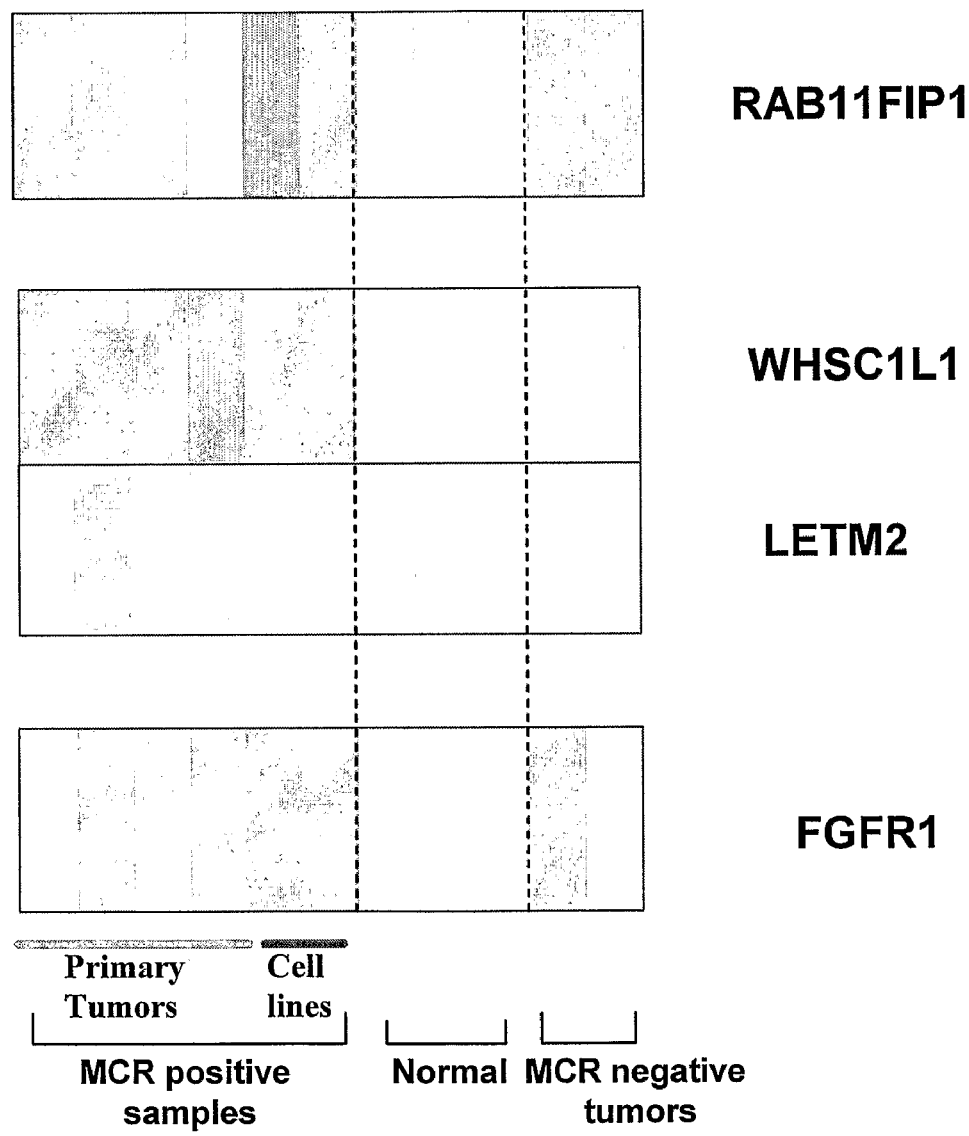
FIG. 5 depicts expression analyses of genes residing in the chromosome 8p12-p11.2 amplicon. Heat map representation of the expression level of each of the genes in the amplicon from Affymetrix analysis. When multiple Affymetrix probes for a gene were present, the median value among the probes was used. Each column represents an individual sample and each row represents a gene. The color intensity on the heat-map correlates with the intensity of the expression. The MCR positive samples include 4 out of 5 squamous primary tumors demonstrating the 8p12-p11.2 amplicon and NCI-H1703 and NCI-H520, the two lung cancer cell lines with the 8p12-p11.2 amplicon. Normal represents 3 independent normal RNA references, isolated from adjacent histologically normal lung tissues, MCR negative tumors are 2 primary tumors not showing amplification at 8p12-p11.2.

Since copy number aberrations are believed to be one of the mechanisms for altered gene expression, integration of DNA copy number and RNA expression data can serve as an effective early filter for culling bystanders from true targets. To this end, the expression pattern of genes residing within this MCR was assessed by both gene expression profiling and by directed RT-QPCR (FIG. 5). RAB11FIP1 and FGFR1 were included in these analyses as controls outside of the centromeric and telomeric boundaries of the MCR, respectively. Specifically, the target(s) should be overexpressed relative to normal, and such overexpression should exhibit copy number driven patterns, namely, overexpression observed in samples harboring the amplicon in question. As shown in FIG. 5, only WHSC1L1 exhibited patterns of expression consistent with that of a candidate target of amplification. In contrast, LETM2 represented a probable bystander based on inconsistent copy number driven overexpression as compared to normal and tumor samples without the amplification. Both RAB11FIP1 and FGFR1 showed an expression pattern that was consistent with their placement outside of the amplicon MCR.

Comparison of the Lung CNAs with Pancreatic CNAs.

Figure 6:
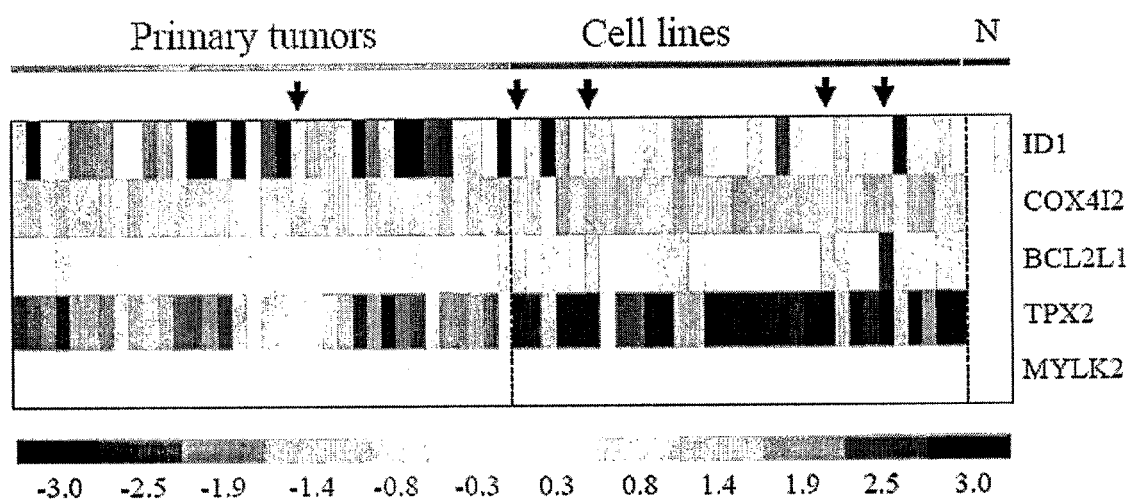
FIG. 6 depicts expression analyses of genes residing in the chromosome 20q11 amplicon. Heat map representation of the expression level of each of the 5 genes, ID1, COX412, BCL2L1, TPX2 and MYLK2, in the amplicon from Affymetrix analysis. When multiple Affymetrix probes for a gene were present, the median value among the probes was used. Each column represents an individual sample and each row represents a gene. The color intensity on the heat-map correlates with the intensity of the expression. The arrows indicate the samples that present amplification.

The very large number of amplifications in human lung cancer presents significant challenges in prioritizing those amplified oncogenes for further validation. Given the common and overlapping role of many bona fide oncogenes or tumor suppressor genes across multiple cancer types, the assumption that the comparison with array-CGH datasets from other cancer types could identify common CNAs harboring highly important oncogenes or tumor suppressor genes was tested. To this end, the NSCLC genome was compared with that of pancreatic ductal adenocarcinoma (PA) genome (Aguirre, A. J., et al. (2004) *Proc Natl Acad Sci USA* 101, 9067-9072). These comparisons identified several loci that are known to be commonly targeted in these cancers including KRAS, c-MYC and INK$^{4a/ARF}$ loci, as well as other novel loci. Among these, one locus on 20q11 (position 29.66-29.88 MB) was amplified in one pancreatic cell line as well as in one lung adenocarcinoma primary tumor and in 4 lung cell lines. Overlap of the aCGH profiles permitted delimitation of an MCR of 220 kB in size (position 29.66 to 29.88 MB) containing 5 genes, ID1, COX412, BCL2L1, TPX2 and MYLK2. Among these, only BCL2L1, a known oncogene implicated in multiple cancer types and TPX2 showed copy-driven expression (FIG. 6). Interestingly, TPX2 showed high-level expression in most lung cell lines and primary tumors tested, when compared with normal controls (FIG. 6). These findings suggest that, in addition to BCL2L1 in this locus, TPX2 also plays a role in lung and pancreatic tumorigenesis.

As described herein, the NSCLC genome is highly complex and rearranged with many previously unrecognized regions of amplification and deletion, all with potential pathogenetic relevance in this lethal disease. In particular, 126 high-confidence CNAs have been identified and defined. It is notable that more than 20% of these (29 of the 126) span less than 0.5 MB with a median of 4 resident genes. The significance of these findings rests on the fact that, to date, only a limited number of genes have been shown to be critical for the pathogenesis and maintenance of non-small cell lung cancer (Minna, J. D., et al. (2002) Cancer Cell 1, 49-52).

As an estimate of the likelihood of discovering novel NSCLC genes from this dataset, the list of genes residing within the high-confident MCRs was compared with the presumed cancer-relevant tyrosine kinases (Bardelli, A., et al. (2003) Science 300, 949), phosphatases (Wang, Z., et al. (2004) Science 304, 1164-1166), the phosphatidylinositol 3-kinases (PI3Ks) (Samuels, Y., et al. (2004) Science 304 554), as well as the current census of cancer genes compiled by Futreal, et al. ((2004) Nat Rev Cancer 4, 177-183). While many implicated cancer genes indeed map to larger CNAs, none of these known cancer genes reside within the coordinates of focal MCRs of 0.5 MB or less (Table 3). Thus, it can be concluded that genes residing within the high-confidence MCRs identified here represent candidates from which novel lung cancer oncogenes and tumor suppressor genes will emerge. Additionally, while none of the proviral common integration sites mapped to any of the focal MCRs, several of the known microRNAs (miRNAs) were located within the MCRs (Table 7). The role of microRNA in cancer has been recently established and the presence of miRNAs within MCRs suggest that they may play a role in carcinogenes in lung cancer (Calin, G. A., et al. (2004a) Proc Natl Acad Sci USA 101, 11755-11760; Calin, G. A., et al. (2004b) Proc Natl Acad Sci USA 101, 2999-3004; Metzler, M., et al. (2004) Genes Chromosomes Cancer 39, 167-169).

Employing custom bioinformatic tools with clinical histopathological correlation, the present high resolution genome-wide analysis has also uncovered a difference in overall genomic complexity between the two major subtypes of NSCLC. Specifically, the squamous cell carcinoma subtype harbors genomic features suggestive of a higher degree of genomic instability compared to the adenocarcinoma subtype, consistent with previous reports (Massion, P. P., et al. (2002) Cancer Res 62, 3636-3640). While the basis for this difference is not clear, it is possible that this higher complexity relates to tobacco smoke exposure. Epidemiological studies have shown that lung squamous carcinomas are more causally linked to tobacco smoke than other lung cancer subtypes. Correspondingly, cytogenetic analyses have shown that adenocarcinomas arising in smokers tend to exhibit higher frequency of chromosomal rearrangements than those in non-smokers (Sanchez-Cespedes, M., et al. (2001) Cancer Res 61, 1309-1313). Taken together, these observations raise the possibility that tobacco smoke may target pathways governing genome stability and/or checkpoint control. In addition to genotoxic properties of its carcinogens, tobacco may also promote local inflammation leading to increased lung epithelial cell renewal, thereby accelerating telomere erosion and eventual entry into crisis, a triad known to engender complex genomic rearrangements (Chin, K., et al. (2004) Nat Genet. 36, 984-988; Kinouchi, Y., et al. (1998) J Gastroenterol 33, 343-348; O'Sullivan, J. N., et al. (2002) Nat Genet. 32, 280-284; Romanov, S. R., et al. (2001) Nature 409, 633-637), as well as epithelial carcinogenesis (Artandi, S. E., et al. (2000) Nature 406, 641-645).

However, irrespective of the mechanistic differences in their evolution, it is most remarkable that the vast majority of CNAs are shared between both squamous cell carcinoma and adenocarcinoma subtypes, an observation pointing to common pathogenetic events driving the transformation of lung epithelial cells. The results presented herein clearly demonstrate that the genome of the lung squamous cell carcinoma possess more focal CNAs than that of the lung adenocarcinomas. Yet, it is striking that despite these wide spread genomic differences only two chromosomal regions are consistently different between these two histological phenotypes. While gain at 22q has not been previously reported as squamous cell carcinoma specific, gains at the telomeric region on chromosome 3q have been consistently, albeit not uniquely, associated with the squamous cell carcinoma subtype (Balsara, B. R., and Testa, J. R. (2002) Oncogene 21, 6877-6883; Bjorkqvist, A. M., et al. (1998) Genes Chromosomes Cancer 22, 79-82; Luk, C., et al. (2001) Cancer Genet Cytogenet 125, 87-99; Pei, J., et al. (2001) Genes Chromosomes Cancer 31, 282-287; Petersen, I., et al. (1997) Cancer Res 57, 2331-2335). Of potential significance is the observation that this region has been reported to be the most common and early genetic alteration in squamous cell carcinomas of the head and neck, a group of tumors that share similar developmental, histological and pathogenetic features with squamous cell carcinomas of the lung (Huang, Q., et al. (2002) Genes Chromosomes Cancer 34, 224-233).

One potential explanation for the similarity between squamous cell carcinomas and adenocarcinomas is that these two histological types of lung cancer are derived from the same lung stem/precursor cell and that only a few number of unique genetic alterations are sufficient to confer to these cells either an adenocarcinoma or a squamous cell carcinoma phenotype. Indeed, there is some experimental evidence that the alveolar type II cell is a pluripotential stem cell involved in the genesis of human adenocarcinoma and squamous cell carcinoma (Ten Have-Opbroek, A. A., et al. (1997) Histol Histopathol 12, 319-336). Additionally, approximately 2% of lung cancers contain both adeno as well as squamous populations of cells—adenosquamous carcinomas (Nakagawa, K., et al. (2003) Ann Thorac Surg 75, 1740-1744; Sridhar, K. S., et al. (1992) Am J Clin Oncol 15, 356-362). Interestingly, it has been shown by genetic and immunohistochemical analysis, that the two populations within each tumor are monoclonal (Kanazawa, H., et al. (2000) Am J Pathol 156, 1289-1298). The data presented herein show that overexpression of genes residing within 3q and possibly 22q, either mediated by amplification or by other mechanisms, could selectively induce lung squamous cell carcinoma phenotypes upon a genetic background that is common between adenocarcinomas and squamous cell carcinomas. Interestingly, among the genes that did show overexpression in squamous samples irrespectively of copy number changes was p63. Overexpression of selective splice variants of p63 has been reported in several squamous carcinomas (Massion, P. P., et al. (2003) Cancer Res 63, 7113-7121; McKeon, F. (2004) Genes Dev 18, 465-469) and mutations in p63 has been reported in several human genetic disorders affecting ectodermal development (Westfall, M. D., and Pietenpol, J. A. (2004) Carcinogenesis 25, 857-864). p63 null-mice show profound defects or frank loss of the entire spectrum of epithelial tissues (Mills, A. A., et al. (1999) Nature 398, 708-713; Yang, A., et al. (1999) Nature 398, 714-718). Conditional transgenic mice expressing p63 isoforms in the epithelial cells lining the bronchioles of the lung developed severe squamous metaplasia (Koster, M. I., et al. (2004) *Genes Dev* 18, 126-131). Together with these findings, other experimental data support the view that p63 exerts a critical role in maintaining the proliferative capacity of epidermal cell populations as well as driving an epithelial stratification program (McKeon, F. (2004) *Genes Dev* 18, 465-469). Other genes overexpressed in 3q irrespective of copy number changes have been implicated in epithelial development and squamous cell carcinomas, such as for example Cystatin A (Ebert, E., et al (1997) *Adv Exp Med Biol* 421, 259-265; Pernu, H., et al. (1990) *Acta Histochem* 88, 53-57) and RP42 (or SCRO, squamous cell carcinoma-related oncogene) (Estilo, C. L., et al. (2003) *Clin Cancer Res* 9, 2300-2306). Based on these data and on the prerogatives of the genes overexpressed in 3q, both adenocarcinomas and squamous cell carcinomas could potentially arise from a common origin, possibly a stem cell. Dysregulation of genes, as for examples genes residing within 3q, could then drive a squamous cell phenotype upon a common tumorigenic background.

Because oncogenes are usually associated with high-level amplifications and tumor suppression genes are often defined by narrow homozygous deletions, it was determined whether the presence of high-intensity events were selectively present in one dataset but not in the other. Besides the amplification on 3q, a second amplicon associated with the squamous cell carcinoma subtype mapped to chromosome 8p12-p11.2 spanning a region of 1.48 MB. Although novel for NSCLC, this amplicon has been observed in several other cancer types including breast, prostate, bladder carcinomas and T-cell lymphomas (Dib, A., et al. (1995) *Oncogene* 10, 995-1001; Edwards, J., et al. (2003) *Clin Cancer Res* 9, 5271-5281; Mao, X., et al. (2003) *J Invest Dermatol* 121, 618-627; Ray, M. E., et al. (2004) *Cancer Res* 64, 40-47; Simon, R., et al. (2001) *Cancer Res* 61, 4514-4519). While FGFR1 resides within this larger CNA and has been considered the prime candidate target of this amplification, detailed QPCR and FISH mapping performed in this study defined both boundaries and narrowed the minimal common region, excluding the FGFR1 gene. Correspondingly, expression analysis demonstrated that FGFR1 was not overexpressed in 4 out of 5 tumors that harbor this amplicon and sequence analysis of exons encoding the juxtamembrane and kinase domains of FGFR1 failed to reveal any mutations. These findings in lung cancer are consistent with recent studies in breast cancer showing that FGFR1 does not play a pathogenetic role in breast cancer cells harboring amplification of this 8p locus (Dib, A., et al. (1995) *Oncogene* 10, 995-1001; Ray, M. E., et al. (2004) *Cancer Res* 64, 40-47), thereby pointing to other resident gene(s) as the true target of this 8p12-p11.2 amplicon such as, for example, the genes showing activity in the tumor cell growth assays.

Gene dosage alterations represent a common mechanism of oncogene activation and tumor suppressor inactivation by modulating expression of their target genes. Thus, integration of DNA copy number with expression provides a powerful early filter for culling bystanders of CNAs. In other words, it is a requirement that the true target of a CNA exhibit appropriate altered expression in a copy number driven manner. However, definition of over- or under-expressed levels is a challenge in itself, particularly in cases where the true cell-of-origin remains unknown and thus a premalignant physiological frame-of-reference is not available. In this study, there are 3 independent normal RNA references, isolated from adjacent histologically normal lung tissues. Using such a reference, one can eliminate LETM2 (leucine zipper-EF-hand containing transmembrane protein 2), since it is not overexpressed in several samples showing amplification. This gene has extensive sequence similarity with LETM1, that encodes a putative member of the EF-hand family of Ca(2+)-binding proteins (Endele, S., et al. (1999) *Genomics* 60, 218-225). These proteins contain two EF-hands, a transmembrane domain, a leucine zipper, and several coiled-coil domains. LETM1 is integral of the inner mitochondrial membrane and is involved in both K+ homeostasis and organelle volume control (Nowikovsky, K., et al. (2004) *J Biol Chem* 279, 30307-30315). Haploinsufficiency of LETM1 has been implicated in the neuromuscular features of WHS patients.

By EST database searching with mouse Nsd1 and utilizing human WHSC1 as probe to screen an amnion cell cDNA library, Angrand et al. ((2001) *Genomics* 74, 79-88) cloned a partial sequence for WHSC1L1. The deduced 1,437-amino acid protein contains 2 PWWP domains involved in protein-protein interaction, 5 PHD-type zinc finger motifs found in chromatin-associated proteins, a SAC (SET-associated cys-rich) domain, a SET domain, and a C-terminal C5HCH domain. They also identified a variant, arising from alternative polyadenylation and exon splicing, that encodes a deduced 645-amino acid peptide that contains a single PWWP domain. WHSC1L1 shares 68% and 55% identity with mouse Nsd1 and human NSD1 respectively, over a 700-amino acid block containing the SAC, SET, and C5HCH domains. Amplification of WHSC1L1 has been demonstrated in breast cancer (Angrand, P. O., et al. (2001) *Genomics* 74, 79-88). Additionally, this gene is involved in a chromosomal translocation, t(8; 11)(p11.2; p15), along with NUP98, that preserves all the domains in WHSC1L1 excluding one PWWP domain (Rosati, R., et al. (2002) *Blood* 99, 3857-3860). This gene belongs to the SET2 family of histone lysine methyltransferases (Schneider, R., et al. (2002) *Trends Biochem Sci* 27, 396-402). Two other genes within this family present extensive sequence similarity with WHSC1L1, NSD1 and WHSC1, and both of them have been implicated in cancer. NSD1 coregulates and transactivates the androgen receptor in prostate cancer cells (Wang, X., et al. (2001) *J Biol Chem* 276, 40417-40423). Additionally, it is fused to the nucleoporin gene NUP98 in the recurrent chromosomal translocation t(5; 11)(q35; p15.5) in de novo childhood acute myeloid leukemia (Jaju, R. J., et al. (2001) *Blood* 98, 1264-1267). WHSC1 is involved in a frequent chromosomal translocation, t(4;14)(p16.3;q32.3), in Multiple Myeloma (Stec, I., et al. (1998) *Hum Mol Genet.* 7, 1071-1082).

The high number of CNAs identified in NSCLC represents a challenge in prioritizing and selecting MCRs for detailed analysis. As many of the already described oncogenes and tumors suppressor genes are involved in tumorigenesis across different tissue types, it was reasoned that mapping overlapping MCR across aCGH datasets of different cancer types might yield novel loci that harbor additional genes essential for tumorigenesis. Indeed, when the recently published pancreatic collection of MCRs was compared (Aguirre, A. J., et al. (2004) *Proc Natl Acad Sci USA* 101, 9067-9072) with the adenocarcinoma and squamous cell carcinoma CNAs, CNAs including known genes already implicated in both cancers, such as KRAS, c-MYC and INK$^{4a}$/ARF were identified. Additionally other novel loci in common between the two datasets were uncovered. Among them, a MCR in chromosome 20 was present in the high-confidence list in both pancreas and lung cancer and contained 5 genes, of which only two showed copy-number driven expression (FIG. 6). The identification of BCL2L1 within a focal amplicon shared between NSCLC and pancreatic adenocarcinoma suggests that one of the mechanisms of BCL2L1 activation in lung cancer is via chromosomal amplification, and confirms a critical oncogenic role in pancreatic adenocarcinoma for BCL2L1, as previously suggested (Bold, R. J., et al. (2001) *Cancer* 92, 1122-1129; Trauzold, A., et al. (2003) *Br J Cancer* 89, 1714-1721; Xu, Z., et al. (2001) *Int J Cancer* 94, 268-274). More surprising is the involvement of TPX2 in this highly recurrent amplicon. TPX2 showed high level of expression not only in the amplified samples but also in samples not showing genome dosage changes. TPX2 is required for targeting Aurora-A kinase to the spindle apparatus. Elevated expression of Aurora-A kinase have been reported in breast, bladder, colon, ovarian and pancreatic cancers and correlates with chromosomal instability and clinically aggressive disease. Up to 62% of breast cancers overexpress Aurora-A kinase, even where gene amplification is not detected. Elevated Aurora-A kinase expression causes abnormalities in mitosis and chromosome segregation and ectopically expressed Aurora-A kinase can transform rodent cells (Anand, S., et al. (2003) *Cancer Cell* 3, 51-62; Bischoff, J. R., et al. (1998) *Embo J* 17, 3052-3065; Miyoshi, Y., et al. (2001) *Int J Cancer* 92, 370-373). However, no reports of specific amplification or overexpression of Aurora-A kinase have been reported in NSCLC. Indeed in the present dataset no amplification of Aurora Kinase A was also evident. TPX2 activates Aurora-A kinase (Gruss, O. J., et al. (2002) *Nat Cell Biol* 4, 871-879) and when overexpressed, it induces accumulation of cells in G2-M phase and polyploidization (Heidebrecht, H. J., et al. (2003) *Mol Cancer Res* 1, 271-279). Manda et al. ((1999) *Genomics* 61, 5-14) have demonstrated that this gene is overexpressed in lung cancer tissue when compared with normal lung and its expression tightly correlates with poor prognosis in patients with neuroblastoma (Krams, M., et al. (2003) *J Clin Oncol* 21, 1810-1818). Additionally, using Oncomine (Rhodes, D. R., et al. (2004) *Neoplasia* 6, 1-6), the expression level of TPX2 in different cancer types was compared to the corresponding levels in normal tissues. Lung squamous cell carcinoma and adenocarcinoma, lung small cell carcinoma (Bhattacharjee, A., et al. (2001) *Proc Natl Acad Sci USA* 98, 13790-13795; Garber, M. E., et al. (2001) *Proc Natl Acad Sci USA* 98, 13784-13789), as well as prostate (Dhanasekaran, S. M., et al. (2001) *Nature* 412, 822-826; LaTulippe, E., et al. (2002) *Cancer Res* 62, 4499-4506) and hepatocellular carcinoma (Chen, X., et al. (2002) *Mol Biol Cell* 13, 1929-1939) showed significant overexpression of TPX2 when compared with the respective normal tissues. Intriguingly, in the present expression dataset, a high correlation existed between TPX2 and Aurora-A kinase expression ($r=0.7801$, $P<0.001$) and correlated even more with many other genes involved in spindle formation and mitotic progression as for example, Bub1 ($r=0.93$, $P<0.001$), CDC20 ($r=0.93$, $P<0.001$), Aurora-B kinase ($r=0.90$, $P<0.001$). The amplification of TPX2 and the correlation of its expression with genes involved in spindle formation and progression through the cell cycle suggest a possible critical role for TPX2 in lung and pancreatic carcinogenesis.

Cross Tumor Type Genomic Comparison

The remarkable degree of overlap between lung cancer subtypes prompted comparison with the recently generated high-resolution genomic profile of another lethal epithelial tumor type, pancreatic adenocarcinoma (PDAC). Although the majority of the defined CNAs are distinct between lung and PDAC, the intersection between these two datasets did reveal 20 shared novel loci, in addition to expected common genomic alterations such as KRAS, c-MYC and INK4a/ARF (Table 3). Thus, cross tumor type comparison holds the potential to serve as filter for CNAs that harbor targets that are potentially relevant to multiple cancer types.

One of the shared loci was a focal amplification at 8p12-p11.2 (position 37.84-39.72 MB) encompassing FGFR1, a cancer-relevant gene not previously implicated in lung cancer. Detailed mapping of the 8p12-p11.2 amplicon by real-time quantitative PCR (QPCR) narrowed the MCR to 0.14 MB in size, as defined by two informative primary tumor cases, PT3 and PT5 (FIG. 4a and data not shown). As QPCR analysis clearly positioned the FGFR1 gene outside of the telomeric boundary, this focal MCR contained only 2 annotated genes: WHSC1L1 and LETM2 (FIG. 4a). Since previous studies have implicated FGFR1 as the prime target of 8p amplicon in other cancer types (Simon, R. et al. (2001) *Cancer Res* 61, 4514-9), interphase FISH was performed to verify the amplicon boundaries in several informative samples. FISH on the six primary tumors and on 2 cell lines showing the amplification confirmed presence of a high-copy number amplicon at 8p (FIG. 4a-b, FIGS. 9-12). Consistent with QPCR data, FISH with a BAC outside of the MCR and including FGFR1 on PT3 revealed only two copies (FIGS. 12a and 12d), providing clear evidence that FGFR1 is not amplified in this sample. The integration of DNA copy number and RNA expression data was used to cull bystanders from true targets of the amplicon (Pollack, J. R. et al. (2002) *Proc Natl Acad Sci USA* 99, 12963-8). Both gene expression profiling and RT-QPCR (FIG. 5 and data not shown) demonstrated consistent overexpression of WHSC1L1. The other MCR resident gene, LETM2, did not show consistent overexpression in the presence of gene amplification. RAB11FIP1 and FGFR1, two genes positioned external to the telomeric and centromeric boundaries of the MCR, respectively showed an expression pattern that was consistent with their placement outside of the amplicon MCR.

To further evaluate the relevance of FGFR1 versus WHSC1L1 in lung cancer, the biological impact of siRNA-mediated knockdown of each target was assessed in cell lines with and without 8p amplification (NCI-H1703 and NCI-H1395 respectively). For all genes, RT-QPCR documented >70% knock-down following SMART siRNA pool transduction (data not shown). In soft agar assays with NCI-H1703, siRNA-mediated knock-down of WHSC1L1 resulted in 50% reduction in the number of H1703 soft agar colonies, while near complete FGFR1 depletion had no impact on colony formation in soft agar. As expected, knock-down of these two genes had no effect on NCI-H1395 colony formation. The copy number-driven expression data, coupled with knock-down studies, argues against a role for FGFR1 in lung cancers harboring an 8p amplicon and points to WUSC1L1 as a potential target of this amplification event.

Figure 4:
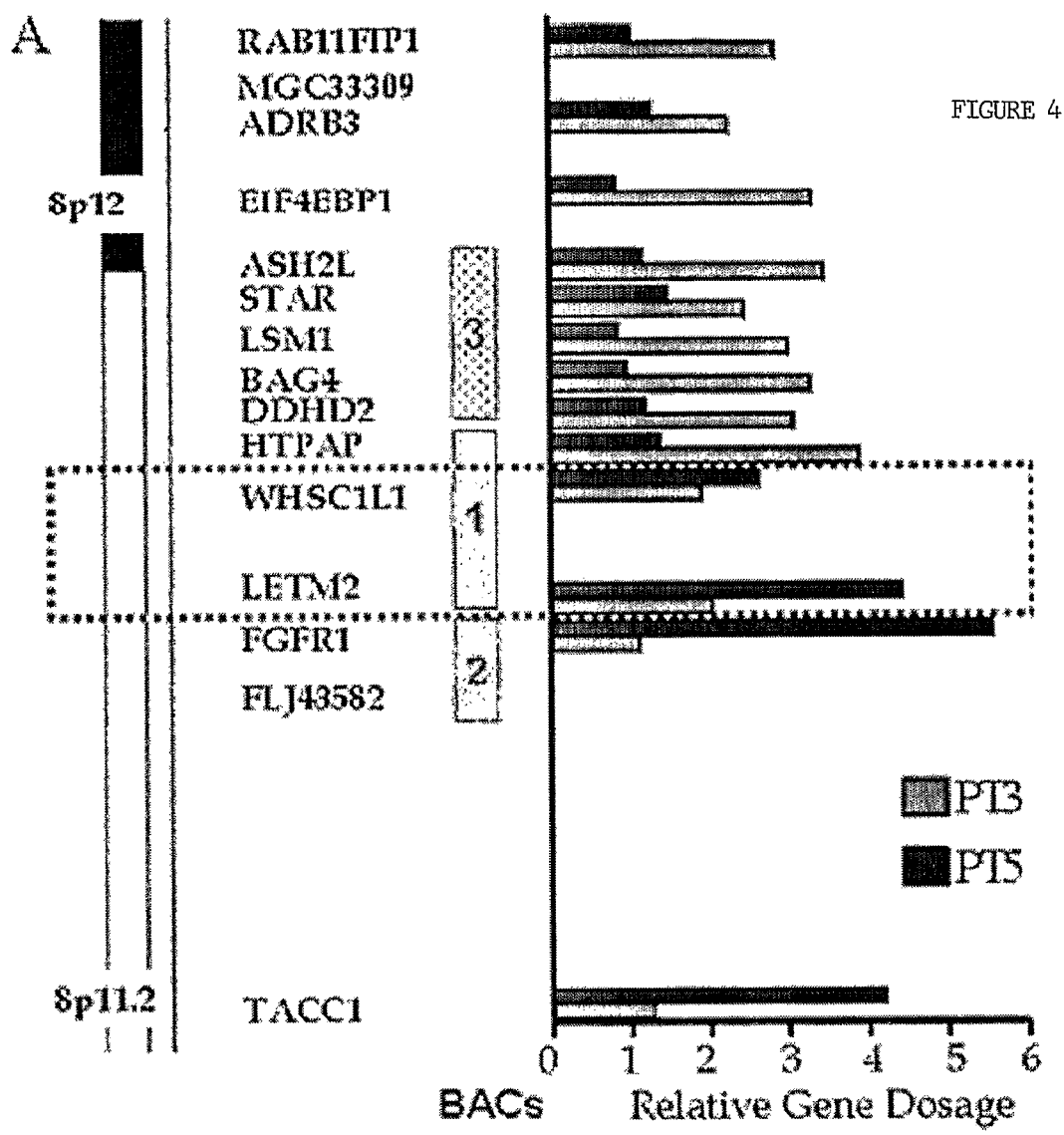
FIGS. 4A-4F depict the verification and boundary delimitation of the 8p12-p11.2 amplicon. (A). Real time PCR verification of the 8p12-p11.2 amplicon and its boundaries. Two primary tumors were used to delimit the boundaries, PT3 (dark gray bars) and PT1 (light gray bars). BAC #1: BAC RP11-265K5; BAC #2: RP11-100B16. Dotted square includes the genes involved in the amplicon. The dotted vertical line identifies the gene dosage threshold above which copy number was considered increased (2-fold). (B). (Upper panel) Metaphase FISH analysis of the cell line NCI-H1703 showing multiple light gray signals on one derivative chromosome (Light gray arrow and left inset. Light gray signal, BAC#2). A normal copy of chromosome 8 is also evident (dark gray arrow and right inset) showing two signals for BAC#2 (light gray) and 2 signals for the control BAC (RP11-138J2, telomeric to the amplicon, at 27 MB, on chr.8, dark gray signal). (Lower panel) Interphase FISH analysis on a section from the primary tumor PT3, comparing adjacent normal and tumor tissues. Note multiple, high-intensity signals with BAC#1 (light gray) in the tumor part and single or double signals with BAC#1 in the normal part of the section. Control BAC (RP11-138J2, is telomeric to the amplicon, at 27 MB, on chr.8, dark gray signal). (C). Interphase FISH analysis on a tissue section from the primary tumor PT3, showing multiple high-intensity signals when using BAC#1 (light gray). Dark gray arrow, control BAC (RP11-138J2, telomeric to the amplicon, at 27 MB, on chr.8, red signal). (D). Interphase FISH analysis on a tissue section from the primary tumor PT3, showing two signals per cell, for both BAC#2 (dark gray signal, white arrow) and control BAC (RP11-138J2, telomeric to the amplicon, at 27 MB, on chromosome 8, light gray signal, light gray arrow). (E). Interphase FISH analysis on a tissue section from the primary tumor PT5, showing multiple high-intensity signals when using BAC#2 (dark gray signal). White arrow, control BAC (RP11-138J2, telomeric to the amplicon, at 27 MB, on chr.8, light gray signal). (F). Interphase FISH analysis on a tissue section from the primary tumor PT5, showing two signals per cell, for both BAC#3 (dark gray signal, dark gray arrow) and control BAC (RP11-138J2, telomeric to the amplicon, at 27 MB, on chr.8, light gray signal, white arrow).
Figure 4:
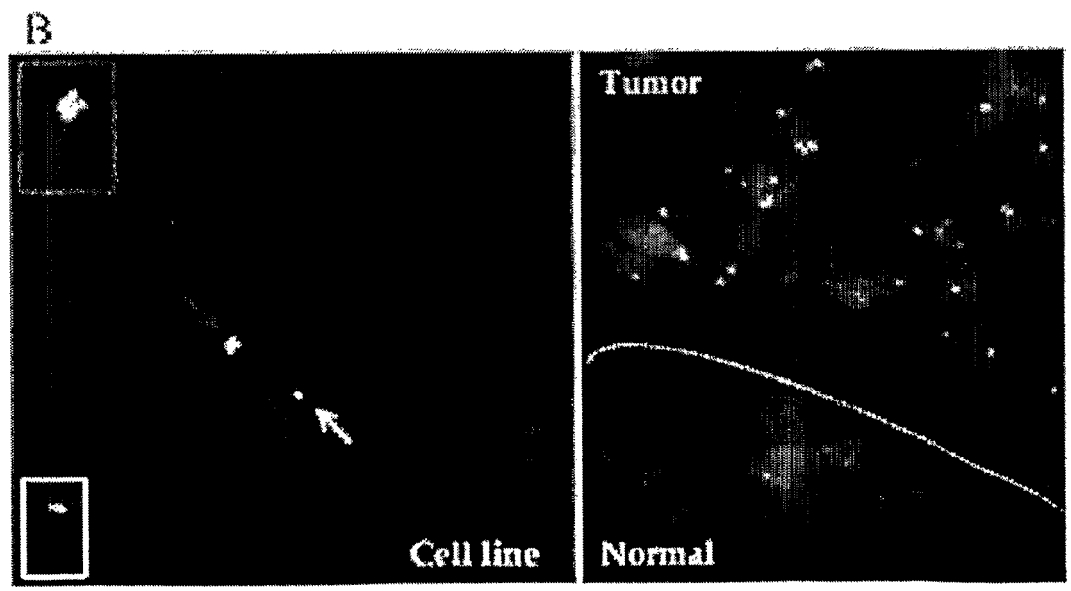
Figure 4:
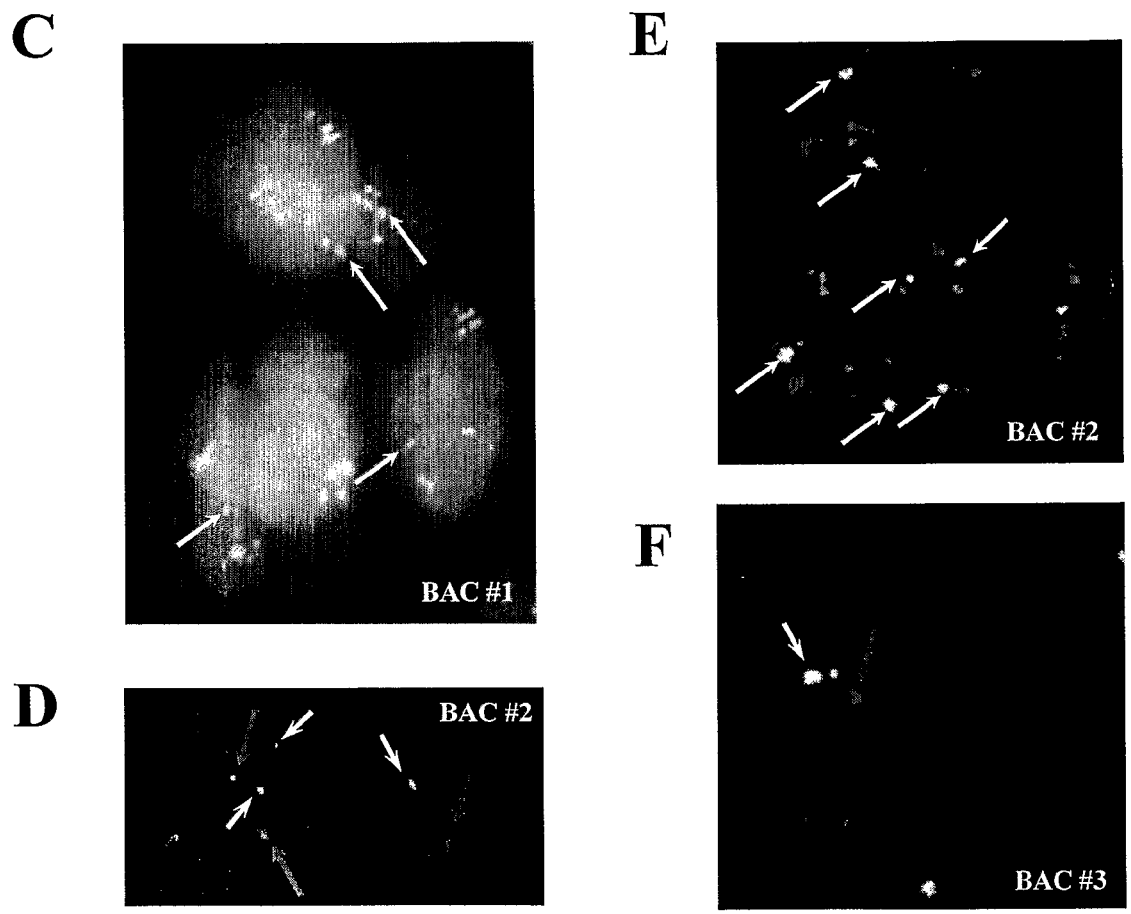

Another amplicon shared in the NSCLC and PDAC datasets mapped to 20q11.2 harboring BCL2L1 (previously BCL-xL), a known oncogene implicated in multiple cancer types. This amplicon was detected in one primary lung AC, one adenosquamous cell line, one SCC cell line and 2 AC cell lines. These samples together delimited the MCR to 220 kB, spanning position 29.66 to 29.88 Mb and containing 5 genes: ID1, COX4I2, BCL2L1, TPX2 and MYLK2. Although BCL2L1 indeed exhibited modestly elevated expression TPX2 was the only gene showing high-level copy number-driven expression in most lung cell lines and primary tumors tested, when compared with RNA derived from normal lung (FIG. 4). These findings suggest that, in addition to a known oncogene BCL2L1, TPX2 is a potential candidate oncogenes targeted for amplification in both lung and pancreas cancers.

Example II

From an initial list of 1848 genes that are amplified in lung cancers, a common set of genes that are amplified in both lung cancers and pancreatic ductal adenocarcinoma based on array CGH analyses were selected. These genes were further selected for their presence in most of the lung cancer primary tumor samples, as resulted from affymetrix expression profile analyses. Affymetrix expression profiles of lung cancer samples were analyzed using the mas5 P/M/A call algorithm implemented in Bioconductor open source project. The gene list was then filtered for targets for either antibody or small molecule therapeutic agents. Genes encoding known transmembrane proteins or secreted proteins were categorized as potential targets for antibody therapy. Genes with products containing in silico predicted transmembrane domains or signal peptide were also categorized as potential targets for antibody therapy unless other evidence indicated that the gene products were not on the cell surface or were extracellular. Known G-protein coupled receptors, enzymes, ion-channels, nuclear receptors, as well as genes encoding proteins containing in silico predicted functional domains for the above classes were categorized as potential targets for small molecule therapeutics. The filtered gene list as described herein is shown in Table 9A. Also included in Table 9 are eleven genes that were selected from LU smallest amplicons (0.5 kb or less) (see Table 9B).

EQUIVALENTS

Those skilled in the art will recognize, or be able to ascertain using no more than routine experimentation, many equivalents to the specific embodiments of the invention described herein. Such equivalents are intended to be encompassed by the following claims.

TABLE 1

Markers of the Invention which reside in MCRs of deletion and display decreased expression.

| Gene Symbol | Chromosome | (start of gene) | Pos (Mb) (end of gene) | Locus Link | MCR ID |
|---|---|---|---|---|---|
| LOC219431 | 11 | 55162578 | 55175891 | GeneID: 219431 | LDLU_11_55.096877_55.175716 |
| OR4C11 | 11 | 55127493 | 55128425 | GeneID: 219429 | LDLU_11_55.096877_55.175716 |
| OR4C16 | 11 | 55096180 | 55097112 | GeneID: 219428 | LDLU_11_55.096877_55.175716 |
| HSMPP8 | 13 | 19105880 | 19144657 | GeneID: 54737 | LDLU_13_19.14411_19.558476 |
| LOC387901 | 13 | 19429449 | 19430578 | GeneID: 387901 | LDLU_13_19.14411_19.558476 |
| LOC390377 | 13 | 19290274 | 19290720 | GeneID: 390377 | LDLU_13_19.14411_19.558476 |
| LOC400099 | 13 | 19336065 | 19337976 | GeneID: 400099 | LDLU_13_19.14411_19.558476 |
| PSPC1 | 13 | 19147528 | 19255082 | GeneID: 55269 | LDLU_13_19.14411_19.558476 |
| ZNF198 | 13 | 19430810 | 19558939 | GeneID: 7750 | LDLU_13_19.14411_19.558476 |
| ZNF237 | 13 | 19309605 | 19335664 | GeneID: 9205 | LDLU_13_19.14411_19.558476 |
| FARP1 | 13 | 97663470 | 97898828 | GeneID: 10160 | LDLU_13_97.474214_97.898599 |
| KPNB3 | 13 | 97404374 | 97474551 | GeneID: 3843 | LDLU_13_97.474214_97.898599 |
| ZNF183L1 | 13 | 97626040 | 97627522 | GeneID: 140432 | LDLU_13_97.474214_97.898599 |
| BAGE3 | 21 | 10042713 | 10080194 | GeneID: 85318 | LDLU_21_9.932177_10.079854 |
| HCP41 | 21 | 9957846 | 9958038 | GeneID: 360186 | LDLU_21_9.932177_10.079854 |
| TPTE | 21 | 9928075 | 10012791 | GeneID: 7179 | LDLU_21_9.932177_10.079854 |
| CASP2 | 7 | 142502239 | 142521622 | GeneID: 835 | LDLU_7_142.276497_142.97 |
| CLCN1 | 7 | 142530056 | 142565934 | GeneID: 1180 | LDLU_7_142.276497_142.97 |
| CTAGE6 | 7 | 142889833 | 142892437 | GeneID: 340307 | LDLU_7_142.276497_142.97 |
| EPHA1 | 7 | 142605042 | 142622822 | GeneID: 2041 | LDLU_7_142.276497_142.97 |
| FLJ40722 | 7 | 142835382 | 142859822 | GeneID: 285966 | LDLU_7_142.276497_142.97 |
| FLJ90586 | 7 | 142498900 | 142501978 | GeneID: 135932 | LDLU_7_142.276497_142.97 |
| GSTK1 | 7 | 142477401 | 142483043 | GeneID: 373156 | LDLU_7_142.276497_142.97 |
| KIAA0773 | 7 | 142567332 | 142575732 | GeneID: 9715 | LDLU_7_142.276497_142.97 |
| LOC154761 | 7 | 142963860 | 142968610 | GeneID: 154761 | LDLU_7_142.276497_142.97 |
| LOC202775 | 7 | 142593623 | 142595003 | GeneID: 202775 | LDLU_7_142.276497_142.97 |
| LOC346521 | 7 | 142526611 | 142526991 | GeneID: 346521 | LDLU_7_142.276497_142.97 |
| LOC441294 | 7 | 142785710 | 142788317 | GeneID: 441294 | LDLU_7_142.276497_142.97 |
| OR10AC1P | 7 | 142724887 | 142725841 | GeneID: 392133 | LDLU_7_142.276497_142.97 |
| OR2R1P | 7 | 142702395 | 142703341 | GeneID: 392132 | LDLU_7_142.276497_142.97 |
| OR6W1P | 7 | 142276218 | 142277719 | GeneID: 89883 | LDLU_7_142.276497_142.97 |
| PIP | 7 | 142346011 | 142353671 | GeneID: 5304 | LDLU_7_142.276497_142.97 |
| TAS2R39 | 7 | 142397349 | 142398362 | GeneID: 259285 | LDLU_7_142.276497_142.97 |
| TAS2R40 | 7 | 142436009 | 142436980 | GeneID: 259286 | LDLU_7_142.276497_142.97 |
| TAS2R41 | 7 | 142691803 | 142692724 | GeneID: 259287 | LDLU_7_142.276497_142.97 |
| TAS2R60 | 7 | 142657383 | 142658339 | GeneID: 338398 | LDLU_7_142.276497_142.97 |
| TAS2R62P | 7 | 142650965 | 142651903 | GeneID: 338399 | LDLU_7_142.276497_142.97 |
| ZYX | 7 | 142595233 | 142605041 | GeneID: 7791 | LDLU_7_142.276497_142.97 |

TABLE 2

Markers of the Invention which reside in MCRs of amplification and display increased expression.

| Gene Symbol | Chromosome | Pos (Mb) (start of gene) | Pos (Mb) (end of gene) | Locus Link | MCR ID |
|---|---|---|---|---|---|
| FLJ13941 | 1 | 2284858 | 2355155 | GeneID: 79906 | LALU_1_2.350016_2.468358 |
| KIAA0450 | 1 | 2442691 | 2469131 | GeneID: 9651 | LALU_1_2.350016_2.468358 |
| PEX10 | 1 | 2368405 | 2376172 | GeneID: 5192 | LALU_1_2.350016_2.468358 |
| RER1 | 1 | 2355491 | 2367352 | GeneID: 11079 | LALU_1_2.350016_2.468358 |

TABLE 2-continued

Markers of the Invention which reside in MCRs of amplification and display increased expression.

| Gene Symbol | Chromosome | Pos (Mb) (start of gene) | Pos (Mb) (end of gene) | Locus Link | MCR ID |
|---|---|---|---|---|---|
| CAMK1G | 1 | 206145440 | 206175679 | GeneID: 57172 | LALU_1_206.174776_206.237991 |
| G0S2 | 1 | 206237160 | 206238128 | GeneID: 50486 | LALU_1_206.174776_206.237991 |
| LAMB3 | 1 | 206176640 | 206214152 | GeneID: 3914 | LALU_1_206.174776_206.237991 |
| CDCA8 | 1 | 37827246 | 37844482 | GeneID: 55143 | LALU_1_37.817059_38.132489 |
| FHL3 | 1 | 38131536 | 38134200 | GeneID: 2275 | LALU_1_37.817059_38.132489 |
| FLJ20508 | 1 | 37816336 | 37825285 | GeneID: 54955 | LALU_1_37.817059_38.132489 |
| FLJ23476 | 1 | 37937707 | 37942939 | GeneID: 79693 | LALU_1_37.817059_38.132489 |
| FLJ31434 | 1 | 37930253 | 37936313 | GeneID: 149175 | LALU_1_37.817059_38.132489 |
| FLJ33655 | 1 | 37895051 | 37899882 | GeneID: 284656 | LALU_1_37.817059_38.132489 |
| FLJ45459 | 1 | 37943062 | 37944219 | GeneID: 127687 | LALU_1_37.817059_38.132489 |
| INPP5B | 1 | 37996852 | 38086883 | GeneID: 3633 | LALU_1_37.817059_38.132489 |
| LOC391026 | 1 | 37901200 | 37914277 | GeneID: 391026 | LALU_1_37.817059_38.132489 |
| LOC440579 | 1 | 37826195 | 37827002 | GeneID: 440579 | LALU_1_37.817059_38.132489 |
| LOC440580 | 1 | 37848654 | 37891456 | GeneID: 440580 | LALU_1_37.817059_38.132489 |
| LOC440581 | 1 | 37917400 | 37929374 | GeneID: 440581 | LALU_1_37.817059_38.132489 |
| MTF1 | 1 | 37948944 | 37992474 | GeneID: 4520 | LALU_1_37.817059_38.132489 |
| SF3A3 | 1 | 38091740 | 38124738 | GeneID: 10946 | LALU_1_37.817059_38.132489 |
| C10orf94 | 10 | 135256286 | 135271757 | GeneID: 93426 | LALU_10_135.2356235_135.275316 |
| CYP2E1 | 10 | 135229746 | 135241501 | GeneID: 1571 | LALU_10_135.2356235_135.275316 |
| FLJ44653 | 10 | 135269237 | 135272343 | GeneID: 399833 | LALU_10_135.2356235_135.275316 |
| BLNK | 10 | 97941447 | 98021316 | GeneID: 29760 | LALU_10_97.622871_98.114607 |
| C10orf130 | 10 | 97749873 | 97769126 | GeneID: 387707 | LALU_10_97.622871_98.114607 |
| CCNJ | 10 | 97793141 | 97810612 | GeneID: 54619 | LALU_10_97.622871_98.114607 |
| DNTT | 10 | 98054202 | 98088311 | GeneID: 1791 | LALU_10_97.622871_98.114607 |
| FLJ34077 | 10 | 97624802 | 97657532 | GeneID: 404033 | LALU_10_97.622871_98.114607 |
| LOC387706 | 10 | 97699715 | 97717198 | GeneID: 387706 | LALU_10_97.622871_198.114607 |
| LOC399804 | 10 | 97939099 | 97940396 | GeneID: 399804 | LALU_10_97.622871_98.114607 |
| TLL2 | 10 | 98114356 | 98263658 | GeneID: 7093 | LALU_10_97.622871_98.114607 |
| TMEM10 | 10 | 98092969 | 98109049 | GeneID: 93377 | LALU_10_97.622871_98.114607 |
| ZNF518 | 10 | 97879646 | 97910520 | GeneID: 9849 | LALU_10_97.622871_98.114607 |
| ERBB3 | 12 | 54760154 | 54782854 | GeneID: 2065 | LALU_12_54.760154_54.840103 |
| FLJ14451 | 12 | 54798297 | 54802545 | GeneID: 84872 | LALU_12_54.760154_54.840103 |
| MBC2 | 12 | 54808321 | 54824722 | GeneID: 23344 | LALU_12_54.760154_54.840103 |
| MLC1SA | 12 | 54833923 | 54838027 | GeneID: 140465 | LALU_12_54.760154_54.840103 |
| MYL6 | 12 | 54838413 | 54841627 | GeneID: 4637 | LALU_12_54.760154_54.840103 |
| PA2G4 | 12 | 54784692 | 54793353 | GeneID: 5036 | LALU_12_54.760154_54.840103 |
| RPL41 | 12 | 54796641 | 54797883 | GeneID: 6171 | LALU_12_54.760154_54.840103 |
| FAM14A | 14 | 93663874 | 93665676 | GeneID: 83982 | LALU_14_93.663981_94.033875 |
| KIAA1622 | 14 | 93710402 | 93815825 | GeneID: 57718 | LALU_14_93.663981_94.033875 |
| SERPINA1 | 14 | 93914463 | 93924877 | GeneID: 5265 | LALU_14_93.663981_94.033875 |
| SERPINA10 | 14 | 93819405 | 93829114 | GeneID: 51156 | LALU_14_93.663981_94.033875 |
| SERPINA11 | 14 | 93978556 | 93998476 | GeneID: 256394 | LALU_14_93.663981_94.033875 |
| SERPINA12 | 14 | 94023374 | 94053934 | GeneID: 145264 | LALU_14_93.663981_94.033875 |
| SERPINA2 | 14 | 93900404 | 93914178 | GeneID: 390502 | LALU_14_93.663981_94.033875 |
| SERPINA6 | 14 | 93840339 | 93859426 | GeneID: 866 | LALU_14_93.663981_94.033875 |
| SERPINA9 | 14 | 94000716 | 94005949 | GeneID: 327657 | LALU_14_93.663981_94.033875 |
| FLJ11171 | 16 | 69873706 | 69881013 | GeneID: 55783 | LALU_16_69.618966_69.899852 |
| HYDIN | 16 | 69618512 | 69822070 | GeneID: 54768 | LALU_16_69.618966_69.899852 |
| DSC1 | 18 | 26963214 | 26996817 | GeneID: 1823 | LALU_18_26.828128_27.310282 |
| DSC2 | 18 | 26900005 | 26936375 | GeneID: 1824 | LALU_18_26.828128_27.310282 |
| DSC3 | 18 | 26825029 | 26876687 | GeneID: 1825 | LALU_18_26.828128_27.310282 |
| DSG1 | 18 | 27152050 | 27190457 | GeneID: 1828 | LALU_18_26.828128_27.310282 |
| DSG3 | 18 | 27281756 | 27310474 | GeneID: 1830 | LALU_18_26.828128_27.310282 |
| DSG4 | 18 | 27210738 | 27247877 | GeneID: 147409 | LALU_18_26.828128_27.310282 |
| KCNC3 | 19 | 55510577 | 55524446 | GeneID: 3748 | LALU_19_55.518384_55.678241 |
| LOC284361 | 19 | 55670405 | 55678420 | GeneID: 284361 | LALU_19_55.518384_55.678241 |
| MYBPC2 | 19 | 55628004 | 55661390 | GeneID: 4606 | LALU_19_55.518384_55.678241 |
| NAPSA | 19 | 55553547 | 55560743 | GeneID: 9476 | LALU_19_55.518384_55.678241 |
| NAPSB | 19 | 55528856 | 55539830 | GeneID: 256236 | LALU_19_55.518384_55.678241 |
| NR1H2 | 19 | 55571550 | 55578051 | GeneID: 7376 | LALU_19_55.518384_55.678241 |
| POLD1 | 19 | 55579408 | 55613082 | GeneID: 5424 | LALU_19_55.518384_55.678241 |
| SPIB | 19 | 55614027 | 55624058 | GeneID: 6689 | LALU_19_55.518384_55.678241 |
| BBS5 | 2 | 170161522 | 170188672 | GeneID: 129880 | LALU_2_170.186554_170.319334 |
| FLJ21901 | 2 | 170211776 | 170255829 | GeneID: 79675 | LALU_2_170.186554_170.319334 |
| KBTBD10 | 2 | 170191719 | 170208279 | GeneID: 10324 | LALU_2_170.186554_170.319334 |
| PPIG | 2 | 170266357 | 170319761 | GeneID: 9360 | LALU_2_170.186554_170.319334 |
| ANKRD23 | 2 | 96925526 | 96931632 | GeneID: 200539 | LALU_2_96.681846_96.952466 |
| CNNM3 | 2 | 96903865 | 96921508 | GeneID: 26505 | LALU_2_96.681846_96.952466 |
| CNNM4 | 2 | 96848754 | 96899485 | GeneID: 26504 | LALU_2_96.681846_96.952466 |
| FLJ10081 | 2 | 96680785 | 96725957 | GeneID: 55683 | LALU_2_96.681846_96.952466 |
| LMAN2L | 2 | 96793540 | 96827675 | GeneID: 81562 | LALU_2_96.681846_96.952466 |
| LOC442030 | 2 | 96730448 | 96739640 | GeneID: 442030 | LALU_2_96.681846_96.952466 |
| LOC90342 | 2 | 96757829 | 96792496 | GeneID: 90342 | LALU_2_96.681846_96.952466 |
| MGC41816 | 2 | 96935654 | 96945622 | GeneID: 51239 | LALU_2_96.681846_96.952466 |
| SEMA4C | 2 | 96947350 | 96957582 | GeneID: 54910 | LALU_2_96.681846_96.952466 |

TABLE 2-continued

Markers of the Invention which reside in MCRs of amplification and display increased expression.

| Gene Symbol | Chromosome | Pos (Mb) (start of gene) | Pos (Mb) (end of gene) | Locus Link | MCR ID |
|---|---|---|---|---|---|
| BCL2L1 | 20 | 29715924 | 29774317 | GeneID: 598 | LALU_20_29.6573635_29.878599 |
| COX4I2 | 20 | 29689352 | 29696461 | GeneID: 84701 | LALU_20_29.6573635_29.878599 |
| ID1 | 20 | 29656753 | 29657974 | GeneID: 3397 | LALU_20_29.6573635_29.878599 |
| MYLK2 | 20 | 29871045 | 29886153 | GeneID: 85366 | LALU_20_29.6573635_29.878599 |
| TPX2 | 20 | 29790565 | 29853264 | GeneID: 22974 | LALU_20_29.6573635_29.878599 |
| BRD9 | 5 | 916856 | 943161 | GeneID: 65980 | LALU_5_0.532951_0.917447 |
| FLJ10565 | 5 | 665461 | 706664 | GeneID: 55722 | LALU_5_0.532951_0.917447 |
| LOC442127 | 5 | 732027 | 747916 | GeneID: 442127 | LALU_5_0.532951_0.917447 |
| SLC9A3 | 5 | 526425 | 577447 | GeneID: 6550 | LALU_5_0.532951_0.917447 |
| TPPP | 5 | 713891 | 731181 | GeneID: 11076 | LALU_5_0.532951_0.917447 |
| ZDHHC11 | 5 | 848907 | 904101 | GeneID: 79844 | LALU_5_0.532951_0.917447 |
| PCDHB10 | 5 | 140552310 | 140555393 | GeneID: 56126 | LALU_5_140.545848_140.662462 |
| PCDHB11 | 5 | 140559532 | 140562802 | GeneID: 56125 | LALU_5_140.545848_140.662462 |
| PCDHB12 | 5 | 140568664 | 140571866 | GeneID: 56124 | LALU_5_140.545848_140.662462 |
| PCDHB13 | 5 | 140573693 | 140577177 | GeneID: 56123 | LALU_5_140.545848_140.662462 |
| PCDHB14 | 5 | 140583262 | 140586044 | GeneID: 56122 | LALU_5_140.545848_140.662462 |
| PCDHB15 | 5 | 140605331 | 140607986 | GeneID: 56121 | LALU_5_140.545848_140.662462 |
| PCDHB16 | 5 | 140541164 | 140545980 | GeneID: 57717 | LALU_5_140.545848_140.662462 |
| PCDHB18 | 5 | 140594307 | 140596906 | GeneID: 54660 | LALU_5_140.545848_140.662462 |
| PCDHB19P | 5 | 140599675 | 140607986 | GeneID: 84054 | LALU_5_140.545848_140.662462 |
| PCDHB9 | 5 | 140547077 | 140551295 | GeneID: 56127 | LALU_5_140.545848_140.662462 |
| SLC25A2 | 5 | 140662380 | 140663616 | GeneID: 83884 | LALU_5_140.545848_140.662462 |
| FGFR1 | 8 | 38389449 | 38445293 | GeneID: 2260 | LALU_8_38.241102_38.45 |
| HTPAP | 8 | 38241417 | 38245872 | GeneID: 84513 | LALU_8_38.241102_38.45 |
| LETM2 | 8 | 38363177 | 38385218 | GeneID: 137994 | LALU_8_38.241102_38.45 |
| LOC441345 | 8 | 38358653 | 38360217 | GeneID: 441345 | LALU_8_38.241102_38.45 |
| WHSC1L1 | 8 | 38251717 | 38358947 | GeneID: 54904 | LALU_8_38.241102_38.45 |

TABLE 3

High-confident focal MCRs

| | Minimal Common Regions (MCRs) | | | | MCR Recurrence | | | | |
| | | | | | Gain/Loss | | Amp/Del | | |
| Cytogenetic Band | Position (MB) | Size (MB) | Max/Min Value | # Transcripts | % | Tumors | Cell lines | Tumors | Cell lines | Candidates |
|---|---|---|---|---|---|---|---|---|---|---|
| Gains/Amplification | | | | | | | | | | |
| 1p36.32-1p36.32 | 2.37-2.47 | 0.10 | 2.92 | 2 | 22 | 9 | 9 | 3 | 0 | PEX10, RER1 |
| 1p34.3-1p34.3 | 37.82-38.13 | 0.32 | 2.16 | 11 | 18 | 7 | 8 | 1 | 1 | FLJ31434, YRDC, FLJ45459 |
| 1q32.2-1q32.2 | 206.17-206.24 | 0.06 | 1.14 | 3 | 39 | 15 | 17 | 1 | 4 | LAMB3 |
| 2q11.2-2q11.2 | 96.68-96.95 | 0.27 | 1.39 | 8 | 35 | 14 | 16 | 4 | 4 | CNNM3, CNNM4, SEMA4C |
| 2q31.1-2q31.1 | 170.19-170.32 | 0.13 | 2.67 | 4 | 28 | 11 | 13 | 1 | 1 | PPIG |
| 5p15.33-5p15.33 | 0.53-0.92 | 0.38 | 1.99 | 5 | 60 | 27 | 24 | 6 | 15 | BRD9 |
| 5q31.3-5q31.3 | 140.55-140.66 | 0.12 | 1.59 | 11 | 19 | 6 | 10 | 2 | 4 | PCDHB11, PCDHB12, PCDHB13 |
| 8p12-8p11.22* | 38.24-38.45* | 0.21 | 1.98 | 2 | 35 | 17 | 12 | 6 | 4 | FGFR1, WHSC1L1, LETM2 |
| 10q24.1-10q24.1 | 97.62-98.11 | 0.49 | 1.96 | 8 | 16 | 3 | 10 | 1 | 1 | CCNJ |
| 10q26.3-10q26.3 | 135.24-135.24 | 0.01 | 1.04 | 1 | 11 | 1 | 8 | 1 | 3 | C10orf94 |
| 12q13.2-12q13.2 | 54.72-54.84 | 0.12 | 1.98 | 8 | 29 | 10 | 14 | 2 | 2 | ERBB3 |
| 14q32.13-14q32.13 | 93.66-94.03 | 0.37 | 1.15 | 9 | 29 | 6 | 18 | 1 | 4 | KIAA1622 |
| 16q22.2-16q22.2 | 69.62-69.87 | 0.26 | 1.4 | 2 | 18 | 6 | 9 | 1 | 4 | Hs.368781 |
| 18q12.1-18q12.1 | 26.83-27.31 | 0.48 | 1.1 | 6 | 19 | 9 | 7 | 2 | 1 | DSC1, DSC2, DSG2 |
| 19q13.33-19q13.33 | 55.52-55.68 | 0.16 | 0.73 | 8 | 17 | 5 | 9 | 1 | 1 | SPIB |
| 20q11.21-20q11.21 | 29.66-29.88 | 0.22 | 1.08 | 5 | 42 | 13 | 23 | 1 | 8 | BCL2L1, TPX2 |
| Loss/Deletion | | | | | | | | | | |
| 7q34-7q34 | 142.28-142.44 | 0.16 | −1.39 | 4 | 13 | 7 | 4 | 2 | 1 | LOC154761 |
| 11q11-11q11^ | 55.1-55.18 | 0.08 | −4.06 | 6 | 23 | 13 | 6 | 7 | 1 | OR4C11, OR4C6, OR4V1P^ |
| 13q12.11-13q12.11 | 19.14-19.56 | 0.41 | −3.51 | 2 | 34 | 14 | 14 | 1 | 7 | HSMPP8, PSPC1 |
| 13q32.2-13q32.2 | 97.47-97.9 | 0.42 | −3.25 | 6 | 29 | 13 | 11 | 1 | 8 | FARP1 |
| 21p11.2-21p11.1 | 9.93-10.08 | 0.15 | −1.33 | 5 | 17 | 9 | 6 | 1 | 1 | TPTE |

TABLE 4

Cell line description.

| Name | ATCC# | Diagnosis | Age/Race/Sex |
| --- | --- | --- | --- |
| NCI-H 522 | CRL 5810 | Adenocarcinoma | 60/White/Male |
| NCI-H1437 | CRL 5872 | Pleural effusion adenocarcinoma | 60/White/Male |
| NCI-H1703 | CRL 5889 | Adenosquamous carcinoma | 54/White/Male |
| NCI-H1975 | CRL 5908 | Adenocarcinoma | NA/NA/Female |
| Hs 618.T | CRL 7380 | Adenocarcinoma | 60/White/Female |
| NCI-H 647 | CRL 5834 | Pleural effusion adenosquamous carcinoma | 56/White/Male |
| NCI-H1781 | CRL 5894 | Pleural effusion adenocarcinoma | 66/White/Female |
| NCI-H1838 | CRL 5899 | Adenocarcinoma | NA/NA/Female |
| NCI-H 2347 | CRL 5942 | Adenocarcinoma | 54/White/Female |
| NCI-H 2122 | CRL 5985 | Pleural effusion adenocarcinoma | 46/White/Female |
| NCI-H23 | CRL 5800 | Adenocarcinoma | 51/Black/Male |
| NCI-H1299 | CRL 5803 | Lymph node carcinoma | 43/White/Male |
| NCI-H 358 | CRL 5807 | Bronchoalveolar carcinoma | NA/NA/Male |
| NCI-H 838 | CRL 5844 | Lymph node adenocarcinoma | 59/White/Male |
| SK-LU-1 | HTB 57 | Adenocarcinoma | 60/White/Female |
| NCI-H 292 | CRL 1848 | Mucoepidermoid pulmonary carcinoma | 32/Black/Female |
| NCI-H1373 | CRL 5866 | Adenocarcinoma | 56/Black/Male |
| NCI-H 1395 | CRL 5868 | Adenocarcinoma | 55/White/Female |
| NCI-H1650 | CRL 5883 | Pleural effusion adenocarcinoma | 27/White/Male |
| H 1944 | CRL 5907 | Soft-tissue adenocarcinoma | 62/White/Female |
| NCI-H1568 | CRL 5876 | Lymph node adenocarcinoma | 48/White/Female |
| NCI-H1993 | CRL 5909 | Lymph node adenocarcinoma | 47/White/Female |
| NCI-H 2170 | CRL 5928 | Squamous cell carcinoma | NA/NA/Male |
| ChaGo-K-1 | HTB 168 | Bronchogenic carcinoma | 45/NA/Male |
| NCI-H 460 | HTB 177 | Pleural effusion carcinoma | NA/NA/Male |
| NCI-H 596 | HTB 178 | Adenosquamous carcinoma | 73/White/Male |
| NCI-H 520 | HTB 182 | Squamous cell carcinoma | NA/NA/Male |
| NCI-H 2030 | CRL 5914 | Lymph node adenocarcinoma | NA/NA/Male |
| NCI-H 1435 | CRL 5870 | Adenocarcinoma | 35/NA/Female |
| NCI-H 1573 | CRL 5877 | Soft tissue adenocarcinoma | 35/White/Female |
| NCI-H 1623 | CRL 5881 | Lymph node adenocarcinoma | 58/White/Male |
| NCI-H 1648 | CRL 5882 | Lymph node adenocarcinoma | 39/Black/Male |
| NCI-H 3255 | | Adenocarcinoma | 47/White/Female |
| DFCI.PT | | Adenocarcinoma | 54/White/Male |

TABLE 5

| Diagnosis | Cellularity (%) | Age/Race/Sex |
| --- | --- | --- |
| Samples obtained from the Cooperative Human Tissue Network (CHTN) Consortium | | |
| Poorly differentiated adenocarcinoma | >70 | 83/Black/Female |
| Adenocarcinoma | >70 | 55/White/Female |
| Metastatic adenocarcinoma | >70 | 73/Black/Female |
| Adenocarcinoma | >70 | 66/B/Male |
| Squamous cell carcinoma | >70 | 74/White/Male |
| Poorly differentiated squamous carcinoma | >70 | 72/Asian/Male |
| Poorly differentiated squamous carcinoma | >70 | 56/Black/Male |
| Adenocarcinoma | >70 | 76/White/Male |
| Squamous cell carcinoma | >70 | 68/White/Female |
| Moderately differentiated adenocarcinoma | >70 | 71/White/Female |
| Moderately differentiated adenocarcinoma | >70 | 78/White/Male |
| Adenocarcinoma | >70 | 46/NA/Male |
| Moderately differentiated squamous cell carcinoma | >70 | 71/White/Male |
| Squamous cell carcinoma | >70 | 47/White/Male |
| Squamous cell carcinoma | >70 | 67/White/Male |
| Squamous cell carcinoma | >70 | 67/White/Male |
| Adenocarcinoma | >70 | 76/White/Male |
| Samples obtained from Brigham and Women Hospital tumor bank. | | |
| Moderately differentiated squamous carcinoma | >70 | 70/NA/Male |
| Poorly differentiated squamous carcinoma | >70 | 57/NA/Male |
| Moderately differentiated squamous carcinoma | >70 | 58/NA/Male |
| Moderately differentiated squamous carcinoma | >70 | 74/NA/Female |
| Poorly differentiated adenocarcinoma | >70 | 66/NA/Male |
| Poorly differentiated adenocarcinoma | >70 | 88/NA/Male |
| Poorly differentiated adenocarcinoma | >70 | 79/NA/Male |
| Moderately differentiated squamous carcinoma | >70 | 70/NA/Male |
| Moderately differentiated squamous carcinoma | >70 | 70/NA/Male |
| Moderately/Poorly (mixed) differentiated adenocarcinoma | >70 | 50/NA/Female |
| Mixed differentiated adenocarcinoma | >70 | 65/NA/Female |
| Moderately differentiated adenocarcinoma | >70 | 49/NA/Female |

TABLE 5-continued

| Diagnosis | Cellularity (%) | Age/Race/Sex |
|---|---|---|
| Moderately/Poorly (mixed) differentiated adenocarcinoma | >70 | 59/NA/Male |
| Moderately/Poorly (mixed) differentiated adenocarcinoma | >70 | 53/NA/Female |
| Poorly differentiated adenocarcinoma | >70 | 66/NA/Male |
| Moderately differentiated squamous carcinoma | >70 | 74/NA/Female |
| Poorly differentiated squamous carcinoma | >70 | 69/NA/Male |
| Poorly differentiated adenocarcinoma | >70 | 72/NA/Male |
| Moderately differentiated squamous carcinoma | >70 | 64/NA/Male |
| Poorly differentiated squamous carcinoma | >70 | 49/NA/Male |
| Poorly differentiated squamous carcinoma | >70 | 74/NA/Female |
| Well differentiated squamous carcinoma | >70 | 51/NA/Male |
| Poorly differentiated squamous carcinoma | >70 | 60/NA/Male |
| Moderately differentiated squamous carcinoma | >70 | 68/NA/Male |
| Moderately/Poorly differentiated squamous carcinoma | >70 | 76/NA/Male |
| Moderately differentiated squamous carcinoma | >70 | 53/NA/Female |
| Squamous carcinoma | >70 | 77/NA/Female |
| Moderately differentiated squamous carcinoma | >70 | 66/NA/Male |

TABLE 6

Oligos

| Primer name | Forward Sequence | Reverse Sequence | Project | DNA only, RNA only or both | PCR, RT PCR, Sequencing |
|---|---|---|---|---|---|
| 80223_Northern | CCGCTCTAATGTCTGCATCA (SEQ ID NO: 341) | CAAAGAGGTTCAGGGAGCTG (SEQ ID NO: 542) | Lung | RNA only | Northern probes |
| 9070_northern | TCGAGCTCCCCATTAAAGA (SEQ ID NO: 342) | AGCCCATGTCACTCATAGGG (SEQ ID NO: 543) | Lung | RNA only | Northern probes |
| 137362_northern | CTTCCAGGACATGGGCTTTA (SEQ ID NO: 343) | ACCAGGTATTCCACCTGCTG (SEQ ID NO: 544) | Lung | RNA only | Northern probes |
| 155_northern | TGACCAACGTGTTCGTGACT (SEQ ID NO: 344) | AGAGTGAAGGTGCCCATGAT (SEQ ID NO: 545) | Lung | RNA only | Northern probes |
| 6770_northern | TAGCGACATTCAAGCTGTGC (SEQ ID NO: 345) | GAGGTCGATGCTGAGTAGCC (SEQ ID NO: 546) | Lung | RNA only | Northern probes |
| 9530_northern | GGAGCAGCCACCATATCCTA (SEQ ID NO: 346) | CTGATGGACACTGCAAGGAA (SEQ ID NO: 547) | Lung | RNA only | Northern probes |
| 23259_northern | GATTTCCAACGTGCAAAGGT (SEQ ID NO: 347) | CAAAGACCCCAGTGGTGAGT (SEQ ID NO: 548) | Lung | RNA only | Northern probes |
| 2260_northern | CGATGTGCAGAGCATCAACT (SEQ ID NO: 348) | TCGATGTGCTTTAGCCACTG (SEQ ID NO: 549) | Lung | RNA only | Northern probes |
| 27257_Northern | AGGAGGGAAGAGGTTTTGGA (SEQ ID NO: 349) | GCCACAGTGATGTGTGAAGG (SEQ ID NO: 550) | Lung | RNA only | Northern probes |
| 1978_Northern | CGGGGACTACAGCACGAC (SEQ ID NO: 350) | GGCGAAGGTGGCTTTTATTT (SEQ ID NO: 551) | Lung | RNA only | Northern probes |
| 84513_Northern | GAGGAGATGTGGCTCTACCG (SEQ ID NO: 351) | TCAGGTTGCTTTCTGAACACC (SEQ ID NO: 552) | Lung | RNA only | Northern probes |
| 22974_Northern | CAGGCTACGGAGAGAACTGG (SEQ ID NO: 352) | GGTGCAGTTGGTGAGGTTTT (SEQ ID NO: 553) | Lung | RNA only | Northern probes |
| 598_Northern | TCTGGTCCCTTGCAGCTAGT (SEQ ID NO: 353) | GCTGAGGCCATAAACAGCTC (SEQ ID NO: 554) | Lung | RNA only | Northern probes |
| LETM2_north | CAAGGAGGAACAGAGCCAAG (SEQ ID NO: 354) | ATTTGTGATTTGGCCTGGAG (SEQ ID NO: 555) | Lung | RNA only | Northern probes |
| W_Northern_both | GGTGCCCGAGAATATCATGT (SEQ ID NO: 355) | GTCTTGCCCCCTGACACTTA (SEQ ID NO: 556) | Lung | RNA only | Northern probes |
| W_Northern_short | CAGAATGCTACAGGGGATGG (SEQ ID NO: 356) | TGGTGGTTTTAGGCTGGAC (SEQ ID NO: 557) | Lung | RNA only | Northern probes |
| W_Northern_long | ATGAAAACCCTTGTGGCTTG (SEQ ID NO: 357) | TCTTCATGCATCTGCTTTGG (SEQ ID NO: 558) | Lung | RNA only | Northern-probes |

TABLE 6-continued

Oligos

| Primer name | Forward Sequence | Reverse Sequence | Project | DNA only, RNA only or both | PCR, RT PCR, Sequencing |
|---|---|---|---|---|---|
| 11102_CDS4_1 | CCCACTAATTTCCAGCCATC (SEQ ID NO: 358) | TGTGAAGGCCCTCCTAAGTT (SEQ ID NO: 559) | Lung | Both DNA_RNA within exon | Real-time PCR |
| 116135_CDS1_1 | ATCATGAGACAGCCCACAAC (SEQ ID NO: 359) | GTGACCAGCATGGCATAATC (SEQ ID NO: 560) | Lung | Both DNA_RNA within exon | Real-time PCR |
| 1230_CDS1_1 | TCATGACCAACAAAGGCAAT (SEQ ID NO: 360) | ATGGGAATTCACTCACCACA (SEQ ID NO: 561) | Lung | Both DNA_RNA within exon | Real-time PCR |
| 128853_CDS4_1 | GCAGCTTCTTCTGTGTCTCTTT (SEQ ID NO: 361) | ACCTGGTGCCTTAGTCCTTG (SEQ ID NO: 562) | Lung | Both DNA_RNA within exon | Real-time PCR |
| 151648_CDS4_1 | GCTGGGCTTGCTTTATTCTT (SEQ ID NO: 362) | CACCTGAAACTCAGCAGTCAC (SEQ ID NO: 563) | Lung | Both DNA_RNA within exon | Real-time PCR |
| 1605_CDS0_1 | CATTGCTCCTCCAACAGAGA (SEQ ID NO: 363) | CAGCTTCTGACACCCGAGTA (SEQ ID NO: 564) | Lung | Both DNA_RNA within exon | Real-time PCR |
| 1776_CDS1_1 | TCCATGGCATTCTTGTCTTC (SEQ ID NO: 364) | TGCTTCTCCTCCTCTCCATC (SEQ ID NO: 565) | Lung | Both DNA_RNA within exon | Real-time PCR |
| 201595_CDS01 | ACCGAACACGTAATGCTGAG (SEQ ID NO: 365) | CTCCCTGTTATCAGGTGCTTT (SEQ ID NO: 566) | Lung | Both DNA_RNA within exon | Real-time PCR |
| 2177_CDS21-1 | GGAGAGCACAGCAGATGAGA (SEQ ID NO: 366) | CAAAGTTCTGCTCCACCAAC (SEQ ID NO: 567) | Lung | Both DNA_RNA within exon | Real-time PCR |
| 3921_W_GENE_1 | TTCTGGGTGAGTTCCGTGTA (SEQ ID NO: 367) | CTGACCGGCTTTCATCACTA (SEQ ID NO: 568) | Lung | Both DNA_RNA within exon | Real-time PCR |
| 4336_CDS0_1 | CTCCGAACACTTCAGCATACA (SEQ ID NO: 368) | GCAGATCCAGTCCTCCTCTT (SEQ ID NO: 569) | Lung | Both DNA_RNA within exon | Real-time PCR |
| 4968_CDS12_1 | GGCCCAGATAAAGGTCATGT (SEQ ID NO: 369) | AGTCCAAGTCCCAGTGTGTG (SEQ ID NO: 570) | Lung | Both DNA_RNA within exon | Real-time PCR |
| 51066_CDS4_1 | GAGTCATGGATTCCACCAGA (SEQ ID NO: 370) | GAAGATGGCCGACACTCTCT (SEQ ID NO: 571) | Lung | Both DNA_RNA within exon | Real-time PCR |
| 5289_CDS13_1 | CCACGTTAGGAGCAACCTTT (SEQ ID NO: 371) | ATGACATCCAAGGAAGCAGA (SEQ ID NO: 572) | Lung | Both DNA_RNA within exon | Real-time PCR |
| 57406_CDS0_1 | GGCCTGCAGTACTCAACTGAC (SEQ ID NO: 372) | GGAGCAGAGCTGAAGCATTT (SEQ ID NO: 573) | Lung | Both DNA_RNA within exon | Real-time PCR |
| 6091_CDS11_1 | TCTCCTCTTTCATATCCTCCAAG (SEQ ID NO: 373) | CCCAGTTCCTCAAGCTCAAT (SEQ ID NO: 574) | Lung | Both DNA_RNA within exon | Real-time PCR |
| 9390_CDS0_1 | CAAATCAGTGCCCTCAGAGA (SEQ ID NO: 374) | TGCTGATGGTCCAGCTCTTA (SEQ ID NO: 575) | Lung | Both DNA_RNA within exon | Real-time PCR |
| 2248_CDS0_1 | TTCACAGACACGTACCACAGTCT (SEQ ID NO: 375) | TCCACGAGCTGGGCTATAAT (SEQ ID NO: 576) | Lung | Both DNA_RNA within exon | Real-time PCR |
| 2249_CDS1_1 | AGGAAGTGGGTGACCTTCAT (SEQ ID NO: 376) | GTGCACGTTCAAGGAGATTC (SEQ ID NO: 577) | Lung | Both DNA_RNA within exon | Real-time PCR |
| 2263_CDS1_1 | CTGTCAACATGCAGAGTGAA (SEQ ID NO: 377) | CACCACGGACAAAGAGATTG (SEQ ID NO: 578) | Lung | Both DNA_RNA within exon | Real-time PCR |
| 9965_CDS2_1 | ATGGGCAGGAAATGAGAGAG (SEQ ID NO: 378) | CAATGTGTACCGATCCGAGA (SEQ ID NO: 579) | Lung | Both DNA_RNA within exon | Real-time PCR |
| 10077_W_GENE_1 | CACCACCCAAGATCCTCTCT (SEQ ID NO: 379) | AGCTCAGGAGACCAGCATTT (SEQ ID NO: 580) | Lung | Both DNA_RNA within exon | Real-time PCR |
| 1073_CDS1_1 | CGATACAGCGAAGGAGTCTAAC (SEQ ID NO: 380) | TTTCAGGGATGGGACAACTT (SEQ ID NO: 581) | Lung | Both DNA_RNA within exon | Real-time PCR |
| 2064_CDS1_1 | TGACACAGCTTATGCCCTATG (SEQ ID NO: 381) | GCAATCTGCATACACCAGTTC (SEQ ID NO: 582) | Lung | Both DNA_RNA within exon | Real-time PCR |

TABLE 6-continued

Oligos

| Primer name | Forward Sequence | Reverse Sequence | Project | DNA only, RNA only or both | PCR, RT PCR, Sequencing |
|---|---|---|---|---|---|
| 26136_CDS3_1 | TGCATCCACAGAGTGCTTTC (SEQ ID NO: 382) | TGCCCTCCTCCTAAGACATC (SEQ ID NO: 583) | Lung | Both DNA_RNA_ within exon | Real-time PCR |
| 6540_CDS11_1 | TTGAGGGTTCCGAGTCTGTAG (SEQ ID NO: 383) | ACTCCGCTGACCTACAACAA (SEQ ID NO: 584) | Lung | Both DNA_RNA_ within exon | Real-time PCR |
| 65980_CDS10_1 | ACACAGTCGGTGGCCTATTA (SEQ ID NO: 384) | GCTGCAGGCTAATCCTTTCT (SEQ ID NO: 585) | Lung | Both DNA_RNA_ within exon | Real-time PCR |
| 836_CDS5_1 | CCAGTGCGTATGGAGAAATG (SEQ ID NO: 385) | GCAATAAATGAATGGGCTGA (SEQ ID NO: 586) | Lung | Both DNA_RNA_ within exon | Real-time PCR |
| 10204_CDS2_3 | TTTCCTCCTCCCTCCTCTTC (SEQ ID NO: 386) | CATCCAAACATCATGCACAA (SEQ ID NO: 587) | Lung | Both DNA_RNA_ within exon | Real-time PCR |
| 123228_CDS0_1 | CTACTGCGGCAATCAGATGT (SEQ ID NO: 387) | GTGACTTCAGGGCTGATGAA (SEQ ID NO: 588) | Lung | Both DNA_RNA_ within exon | Real-time PCR |
| 3911_CDS3_1 | GGTGGAAGGGCCAAATATAA (SEQ ID NO: 388) | GGTGTCTATTTGGACTCTAAGCTCT (SEQ ID NO: 589) | Lung | Both DNA_RNA_ within exon | Real-time PCR |
| 4649_CDS0_1 | GCCAATGCATAGAATCCAAA (SEQ ID NO: 389) | AGCTGCATATCACCCAACAC (SEQ ID NO: 590) | Lung | Both DNA_RNA_ within exon | Real-time PCR |
| 56654_W_GENE_1 | GAGACACAGAGACGCACACA (SEQ ID NO: 390) | GTTCCCAGAGGCGTACCTTA (SEQ ID NO: 591) | Lung | Both DNA_RNA_ within exon | Real-time PCR |
| 8065_COS0_1 | TTGGAGGTAACCACGTTTCA (SEQ ID NO: 391) | TCAGCATCAGGGAGTTCAGTT (SEQ ID NO: 592) | Lung | Both DNA_RNA_ within exon | Real-time PCR |
| 2260_CDS0_1 | TCTGGCTGTGGAAGTCACTC (SEQ ID NO: 392) | GGAGATCATCATCTATTGCACAG (SEQ ID NO: 593) | Lung | Both DNA_RNA_ within exon | Real-time PCR |
| 2037_CDS1_1 | CATCTTGTACCACGGCAATG (SEQ ID NO: 393) | TGGTGTCATGGACCAAAGTC (SEQ ID NO: 594) | Lung | Both DNA_RNA_ within exon | Real-time PCR |
| 6582_CDS1_1 | GAATTCAACCAGGGCAGAGT (SEQ ID NO: 394) | GTTCACGAGCTCTGTGCTCTA (SEQ ID NO: 595) | Lung | Both DNA_RNA_ within exon | Real-time PCR |
| 1230_CDS0_1 | AACGGACAGCTTTGGATTTC (SEQ ID NO: 395) | ACCTCTTTGGGCTGGTATTG (SEQ ID NO: 596) | Lung | Both DNA_RNA_ within exon | Real-time PCR |
| 1232_W_GENE_1 | TGGAGGCGTAGTGGTAACAG (SEQ ID NO: 396) | ACCTGCTGTGGTGGTTTGTA (SEQ ID NO: 597) | Lung | Both DNA_RNA_ within exon | Real-time PCR |
| 1605_CDS0_1 | GGTGGTATCATCTGCCTGTG (SEQ ID NO: 397) | GTGCAGGAGGTCAATCCTTT (SEQ ID NO: 598) | Lung | Both DNA_RNA_ within exon | Real-time PCR |
| 84276_CDS2_1 | CAGGCAGCAGAAGAGTTCAG (SEQ ID NO: 398) | TGGGACACTTGAGGAAGAAA (SEQ ID NO: 599) | Lung | Both DNA_RNA_ within exon | Real-time PCR |
| 8927_CDS0_1 | ATGGCAGAGCAGAACATCAG (SEQ ID NO: 399) | GTGTTATAGTTGGCTGGGCTCT (SEQ ID NO: 600) | Lung | Both DNA_RNA_ within exon | Real-time PCR |
| 10324_CDS1_1 | GGAAAGATCTGGCTCCAATG (SEQ ID NO: 400) | CAACTGAAGCTGAAAGACCATC (SEQ ID NO: 601) | Lung | Both DNA_RNA_ within exon | Real-time PCR |
| 114990_CDS1_1 | GCCCTACATCTAAGCCAGAGA (SEQ ID NO: 401) | CGAGGTTGGGACTGAGAACT (SEQ ID NO: 602) | Lung | Both DNA_RNA_ within exon | Real-time PCR |
| 1571_CDS2_1 | GTCATAGCCGACATCCTCTTC (SEQ ID NO: 402) | TGCTGAGTAGGTGGAAGTTCTC (SEQ ID NO: 603) | Lung | Both DNA_RNA_ within exon | Real-time PCR |
| 1746_CDS0_1 | GGGACGAACTGGTTCCATAG (SEQ ID NO: 403) | GCACATGGGTTCCTACCAGT (SEQ ID NO: 604) | Lung | Both DNA_RNA_ within exon | Real-time PCR |
| 4661_CDS10_1 | TTGGGTCAAATTGCTGAAGA (SEQ ID NO: 404) | ATCCTCTGGCTGGATGAAGA (SEQ ID NO: 605) | Lung | Both DNA_RNA_ within exon | Real-time PCR |
| 51608_CDS0_1 | CAAATAACCGGTCCAGGAGT (SEQ ID NO: 405) | CATGCACAACTGCGTATCAA (SEQ ID NO: 606) | Lung | Both DNA_RNA_ within exon | Real-time PCR |

TABLE 6-continued

Oligos

| Primer name | Forward Sequence | Reverse Sequence | Project | DNA only, RNA only or both | PCR, RT PCR, Sequencing |
|---|---|---|---|---|---|
| 56121_W_GENE_1 | ACGGGAGGCTCTGAAAGTAA (SEQ ID NO: 406) | ACGGTCGGAAAGCTACAGAT (SEQ ID NO: 607) | Lung | Both DNA_RNA within exon | Real-time PCR |
| 57596_CDS2_1 | AGAAGCTGTCGGCCTTGTAG (SEQ ID NO: 407) | ACCCTGCAGCTTCTCTGAAC (SEQ ID NO: 608) | Lung | Both DNA_RNA within exon | Real-time PCR |
| 84809_CDS4_1 | TTCAAGGAACACCAGGATAGAA (SEQ ID NO: 408) | CCTCTCTCCACCGAGCTATC (SEQ ID NO: 609) | Lung | Both DNA_RNA within exon | Real-time PCR |
| 8837_CDS1_1 | TCACCGACGAGTCTCAACTAA (SEQ ID NO: 409) | CGTGGTCCTTGTTGTCTCAG (SEQ ID NO: 610) | Lung | Both DNA_RNA within exon | Real-time PCR |
| 9742_CDS12_1 | ACTCCCTTCAAAGGAATGAATC (SEQ ID NO: 410) | GTGTTGGAATACGCGACAGA (SEQ ID NO: 611) | Lung | Both DNA_RNA within exon | Real-time PCR |
| 1978_EXON1 | CAGCAGCTGCAGCCAGAC (SEQ ID NO: 411) | GGGGTGGTGCTGAAGAGC (SEQ ID NO: 612) | Lung | Both DNA_RNA within exon | Real-time PCR |
| 55107_EXON2 | CTTATCTGTGGACCCTGATGC (SEQ ID NO: 412) | GAGGGCCTCTTGTGATGGTA (SEQ ID NO: 613) | Lung | Both DNA_RNA within exon | Real-time PCR |
| 5326_W_GENE_2 | GGCTATCTGGAGCAGGAAAG (SEQ ID NO: 413) | TCCCTGGAGACCCAGATAAG (SEQ ID NO: 614) | Lung | Both DNA_RNA within exon | Real-time PCR |
| 137362_CDS0_1 | ATCATTCATCCAGGCCTCTC (SEQ ID NO: 414) | TGCCAAGCTCTGAGAAACTG (SEQ ID NO: 615) | Lung | RNA only | Real-time PCR |
| 137994_CDS0_1 | GGGATGAGATCACTGGGTCT (SEQ ID NO: 415) | GGCTTGGGCTTCACATCTAT (SEQ ID NO: 616) | Lung | RNA only | Real-time PCR |
| 2249_CDS0_1 | CCCAACAACTACAACGCCTAC (SEQ ID NO: 416) | AGGAAGTGGGTGACCTTCAT (SEQ ID NO: 617) | Lung | RNA only | Real-time PCR |
| 22941_CDS0_1U | TCGAGACGACCAGCACTATC (SEQ ID NO: 417) | CATAAATGCTTGCCCATCTG (SEQ ID NO: 618) | Lung | RNA only | Real-time PCR |
| 25960_CDS0_1 | CTGGAGGGATTCCACTCATT (SEQ ID NO: 418) | TCAAAGCCACAGGGATGTAG (SEQ ID NO: 619) | Lung | RNA only | Real-time PCR |
| 55107_CDS0_1 | AAGGACATCAGCCAGGAGAT (SEQ ID NO: 419) | TCCTTCTCCATCCAGGTTTC (SEQ ID NO: 620) | Lung | RNA only | Real-time PCR |
| 6770_CDS0_1 | CTGGCATGGACACAGACTTC (SEQ ID NO: 420) | TAGAGGGACTTCCAGCCAAC (SEQ ID NO: 621) | Lung | RNA only | Real-time PCR |
| 80223_CDS0_1 | ATCCCTAGCACGACACCTTC (SEQ ID NO: 421) | AAGAGGCGTCTTCTGCAAAT (SEQ ID NO: 622) | Lung | RNA only | Real-time PCR |
| 84513_CDS0_1 | AGATGTGGCTCTACCGGAAC (SEQ ID NO: 422) | GGCTTGTCTGCTGTCTCTTG (SEQ ID NO: 623) | Lung | RNA only | Real-time PCR |
| 8772_CDS0_1 | GAAGACCTGTGTGCAGCATT (SEQ ID NO: 423) | GCTGTCGATCTTGGTGTCTG (SEQ ID NO: 624) | Lung | RNA only | Real-time PCR |
| 9070_CDS0_1 | TGCCATCACAGTGGGAATAC (SEQ ID NO: 424) | TTCGGATGTTCATCCTGTGT (SEQ ID NO: 625) | Lung | RNA only | Real-time PCR |
| 9530_CDS0_1 | GCACAACTTTCCTTGCAGTG (SEQ ID NO: 425) | TTGATTGTTGGGATGGTCAC (SEQ ID NO: 626) | Lung | RNA only | Real-time PCR |
| 400841_DNA | ACAGGGGAGACAGAGCAAGA (SEQ ID NO: 426) | CTGGAAAAGCCACCTTTTTG (SEQ ID NO: 627) | Lung | Both DNA_RNA within exon | Real-time PCR |
| 155_CDS0_1 | GGAGCTCCAGGGTTCATAAG (SEQ ID NO: 427) | AAACAAACGGAGGGAAAGTG (SEQ ID NO: 628) | Lung | RNA only | Real-time PCR |
| 1978_CDS0_1 | CAGCCAGGCTTATGAAAGT (SEQ ID NO: 428) | GTGGAGGCACAAGGAGGTAT (SEQ ID NO: 629) | Lung | RNA only | Real-time PCR |
| 220064_CDS0_1 | TGCCTCCCGTGTGTTATTTA (SEQ ID NO: 429) | TTAGACCAGGCAATCCCTTC (SEQ ID NO: 630) | Lung | RNA only | Real-Time PCR |

TABLE 6-continued

Oligos

| Primer name | Forward Sequence | Reverse Sequence | Project | DNA only, RNA only or both | PCR, RT PCR, Sequencing |
|---|---|---|---|---|---|
| 2248_CDS0_1 | ATAACCTGGAGCCCTCTCAC (SEQ ID NO: 430) | GGCTCAAGGAGGAGAGTCAG (SEQ ID NO: 631) | Lung | RNA only | Real-time PCR |
| 23259_CDS0_1 | GCCAAGTTGTGGTCTTCAAA (SEQ ID NO: 431) | AGGGCTATGCTGTCCATCTT (SEQ ID NO: 632) | Lung | RNA only | Real-time PCR |
| 27257_CDS0_1 | CGGTAGGAGGGAAGAGGTTT (SEQ ID NO: 432) | CATCTCGAAGCAGAACCAAG (SEQ ID NO: 633) | Lung | RNA only | Real-time PCR |
| 11160_CDS0_1 | GGCTCAGAGTGGTGGTTTCT (SEQ ID NO: 433) | GATGCTGAGTGGAACCAATG (SEQ ID NO: 634) | Lung | Both DNA_RNA_ within exon | Real-time PCR |
| 137362_CDS0_1 | CTGGCTGCAGAAGAACTCAA (SEQ ID NO: 434) | GAGCAAGCAGATATTCCCATTT (SEQ ID NO: 635) | Lung | Both DNA_RNA_ within exon | Real-time PCR |
| 137994_CDS2_1 | CCCAGCACAAAGGAGATAGTT (SEQ ID NO: 435) | CAGGTTGTTGGTTCCAAATG (SEQ ID NO: 636) | Lung | Both DNA_RNA_ within exon | Real-time PCR |
| 22974_CDS0_1 | GAGGGCCTTTCTGGTTCTCT (SEQ ID NO: 436) | TAGTCTGGCCTCCTCCAACT (SEQ ID NO: 637) | Lung | Both DNA_RNA_ within exon | Real-time PCR |
| 25960_CDS16_1 | CATCACTCTGGCCTCATCAC (SEQ ID NO: 437) | TGTCTGTGCAGCAAGCATAA (SEQ ID NO: 638) | Lung | Both DNA_RNA_ within exon | Real-time PCR |
| 27257_CDS3_1 | GTCTGTGATCAAATGCGTGA (SEQ ID NO: 438) | TCCATTCCTCGAGCAGATACT (SEQ ID NO: 639) | Lung | Both DNA_RNA_ within exon | Real-time PCR |
| 54904_CDS0_2 | CTCAGCCAGTAATTCTTCATACTGTCCCGAGAATATCATGTCCAGT (SEQ ID NO: 439) | (SEQ ID NO: 640) | Lung | Both DNA_RNA_ within exon | Real-time PCR |
| 55290_CDS1_1 | TCTTCACCAGTTCTGCCAAG (SEQ ID NO: 440) | GCACGCTGTTGTATGCAGAT (SEQ ID NO: 641) | Lung | Both DNA_RNA_ within exon | Real-time PCR |
| 6770_CDS1_1 | GCTGCTTGTTCTGTGGTGTT (SEQ ID NO: 441) | CTTGCTTTATGGGCTCAAGA (SEQ ID NO: 642) | Lung | Both DNA_RNA_ within exon | Real-time PCR |
| 6867_CDS10_1 | GGCAGTGATCTCCCAGATTT (SEQ ID NO: 442) | TCTTCCTCTGGCTCACCTTT (SEQ ID NO: 643) | Lung | Both DNA_RNA_ within exon | Real-time PCR |
| 80223_CDS0_1 | CTCCTGCTCTCTGGCTTCTT (SEQ ID NO: 443) | CTATGACCCTGCCGTCCTAC (SEQ ID NO: 644) | Lung | Both DNA_RNA_ within exon | Real-time PCR |
| 84513_CDS4_1 | TCATTGTCAGGTTGCTTTCTG (SEQ ID NO: 444) | TGGGCAGATGAATAGCAATAAG (SEQ ID NO: 645) | Lung | Both DNA_RNA_ within exon | Real-time PCR |
| 9070_CDS0_1 | TGGAACACCCGTTTAACAAA (SEQ ID NO: 445) | CGTTCATACAAGCAGGCTCT (SEQ ID NO: 646) | Lung | Both DNA_RNA_ within exon | Real-time PCR |
| 9530_CDS3_1 | GCACAACTTTCCTTGCAGTG (SEQ ID NO: 446) | GATGGTCACTGGTGGCATAA (SEQ ID NO: 647) | Lung | DNA only | Real-time PCR |
| 23259 | TCCCTAGACGGACATTGAGG (SEQ ID NO: 447) | CAAAGACCCCAGTGGTGAGT (SEQ ID NO: 648) | Lung | DNA only | Real-time PCR |
| 11212_CDS2_2 | CTCGCAAGAACCATCTGACA (SEQ ID NO: 448) | GGGATCCTGTTTCCTTTCAA (SEQ ID NO: 649) | Lung | Both DNA_RNA_ within exon | Real-time PCR |
| 2017_CDS11_1 | AGGCAGAGCTGAGCTACAGAG (SEQ ID NO: 449) | CCTCTGCGCTTTCATAGACA (SEQ ID NO: 650) | Lung | Both DNA_RNA_ within exon | Real-time PCR |
| 8500_CDS0_1 | GTGCTTGTTTGGAGCAATGA (SEQ ID NO: 450) | TGCACTGAAGTCGAAGGTTT (SEQ ID NO: 651) | Lung | Both DNA_RNA_ within exon | Real-time PCR |
| 8772_CDS1_1 | ACACCAAGATCGACAGCATC (SEQ ID NO: 451) | TTGCGTTCTCCTTCTCTGTG (SEQ ID NO: 652) | Lung | Both DNA_RNA_ within exon | Real-time PCR |
| 55290_CDS0_1 | CATCTGCACGCTGTTGTATG (SEQ ID NO: 452) | GCTGCTGCAATAGGTCTTCA (SEQ ID NO: 653) | Lung | RNA only | Real-time PCR |
| 595_CDS0_1 | TCCTGGTGAACAAGCTCAAG (SEQ ID NO: 453) | GTGTTTGCGGATGATCTGTT (SEQ ID NO: 654) | Lung | RNA only | Real-time PCR |

TABLE 6-continued

Oligos

| Primer name | Forward Sequence | Reverse Sequence | Project | DNA only, RNA only or both | PCR, RT PCR, Sequencing |
|---|---|---|---|---|---|
| 9965_CDS0_1 | CCACCAGGCTTCAGGAGTAG (SEQ ID NO: 454) | ACCGGGACAGCAAGTTATTC (SEQ ID NO: 655) | Lung | RNA only | Real-time PCR |
| 116461_CDS2_1 | CCACTGCAGCTACCGTAGAA (SEQ ID NO: 455) | ACTGCAATGGGAAGACCAAT (SEQ ID NO: 656) | Lung | Both DNA_RNA within exon | Real-time PCR |
| 126789_CDS4_1 | GGTGAAGACGATTCTGGAGAG (SEQ ID NO: 456) | GTTCCCGTACAGCACTGACTT (SEQ ID NO: 657) | Lung | Both DNA_RNA within exon | Real-time PCR |
| 170575_CDS0_1 | ACTTGGTTAAGGGAGGCTGA (SEQ ID NO: 457) | GCAAAGTTGCAAAGGTGATG (SEQ ID NO: 658) | Lung | Both DNA_RNA within exon | Real-time PCR |
| 22823_CDS1_1 | AGAAAGGACCAAATGCCAAA (SEQ ID NO: 458) | AACACTGCTGGACATTGGTTT (SEQ ID NO: 659) | Lung | Both DNA_RNA within exon | Real-time PCR |
| 3987_CDS7_1 | AGCTGAGACCTTAGGAAGGAAAT (SEQ ID NO: 459) | TCCTCTTCTCTCAACTGCTTTG (SEQ ID NO: 660) | Lung | Both DNA_RNA within exon | Real-time PCR |
| 4705_CDS2_1 | ACTGTTGCCATCATTGCTTC (SEQ ID NO: 460) | TCCAGACAGTACCACAGGAGA (SEQ ID NO: 661) | Lung | Both DNA_RNA within exon | Real-time PCR |
| 5214_CDS14_1 | GAGAAGCACGAGGAGTTCTGT (SEQ ID NO: 461) | GATAGTGTTCAGGGCGGTGT (SEQ ID NO: 662) | Lung | Both DNA_RNA within exon | Real-time PCR |
| 55425_CDS7_1 | GATGACTGAACTTCCTCCAGAA (SEQ ID NO: 462) | CCTTTCCCTATCAGCTGGAGT (SEQ ID NO: 663) | Lung | Both DNA_RNA within exon | Real-time PCR |
| 9134_CDS11_1 | TAGGAAGGAGCCACAGCATT (SEQ ID NO: 463) | TTGCCTTGCCATAACACATT (SEQ ID NO: 664) | Lung | Both DNA_RNA within exon | Real-time PCR |
| 2260_RNA | gaacaggcatgcaagtgaga (SEQ ID NO: 464) | gctgtagccctgaggacaag (SEQ ID NO: 665) | Lung | RNA only | Real-time PCR |
| 10160 | TCTCTAAGCCGCTTTCATCA (SEQ ID NO: 465) | TCCACGTTCCAAGGTACTGA (SEQ ID NO: 666) | Lung | Both DNA_RNA within exon | Real-time PCR |
| 1161 | ACTGAAATACACAGCAGTCAACAGTGGCTGCAGTTCAGAATTTGTT (SEQ ID NO: 466) | (SEQ ID NO: 667) | Lung | Both DNA_RNA within exon | Real-time PCR |
| 3248 | CTAGCCTTTGGTCCACATCA (SEQ ID NO: 467) | TCCTTCATGCACTTGGTGATA (SEQ ID NO: 668) | Lung | Both DNA_RNA within exon | Real-time PCR |
| 4256 | CGCTTCCTGAAGTAGCGATT (SEQ ID NO: 468) | CCTGTCCACGAGCTCAATAG (SEQ ID NO: 669) | Lung | Both DNA_RNA within exon | Real-time PCR |
| 5720 | GGCCCTGTAGGCTGTGTTAT (SEQ ID NO: 469) | GGGAGAGAGGGCTCTCAATA (SEQ ID NO: 670) | Lung | Both DNA_RNA within exon | Real-time PCR |
| 580 | CCTGACAGCTCATTGTCATGTA (SEQ ID NO: 470) | GACTGCATTGGAACTGGATG (SEQ ID NO: 671) | Lung | Both DNA_RNA within exon | Real-time PCR |
| 64122 | GATCCTTCTTCACCGCCTAC (SEQ ID NO: 471) | GGTTCCAGTGGTTCAGGTAGT (SEQ ID NO: 672) | Lung | Both DNA_RNA within exon | Real-time PCR |
| 80704 | GCCCAGATATTGGCTGTGTA (SEQ ID NO: 472) | GTGGGTTATGTGAAAGTCAACTG (SEQ ID NO: 673) | Lung | Both DNA_RNA within exon | Real-time PCR |
| 9169 | TTTGGAGCCTGTCTTGTTTG (SEQ ID NO: 473) | GAGCTGAAACAGCCAGTCAG (SEQ ID NO: 674) | Lung | Both DNA_RNA within exon | Real time PCR |
| 155 | GTGTCCGTGGGTCAACTTTT (SEQ ID NO: 474) | GTGACTGGATCCGGAAAGAA (SEQ ID NO: 675) | Lung | Both DNA_RNA within exon | Real-time PCR |
| 137994_CDS0_1_RNA | ATAGATGTGAAGCCCAAGCC (SEQ ID NO: 475) | TCAGTTGAGGTGCAAGATCC (SEQ ID NO: 676) | Lung | RNA only | Real-time PCR |
| 54904_CDS0_2_RNA | TTAACCGTCTCCTTGGTTCC (SEQ ID NO: 476) | TCCAGCCAAAACAATAGTGC (SEQ ID NO: 677) | Lung | RNA only | Real-time PCR |
| 2017_RNA | TCTCCAAGCGGAAAGAAAGA (SEQ ID NO: 477) | CACAAAATCAGGGTCGGTCT (SEQ ID NO: 678) | Lung | RNA only | Real-time PCR |

TABLE 6-continued

Oligos

| Primer name | Forward Sequence | Reverse Sequence | Project | DNA only, RNA only or both | PCR, RT PCR, Sequencing |
|---|---|---|---|---|---|
| 8500_RNA | CCACATCTGTGCATGACCTC (SEQ ID NO: 478) | TTCCAAGCGCTCCTGTAACT (SEQ ID NO: 679) | Lung | RNA only | Real-time PCR |
| 1978_RNA_DNA | CTTCGTGAACACCAGCAGAT (SEQ ID NO: 479) | GAAGGAAGGGTTCGTTCTTG (SEQ ID NO: 680) | Lung | Both DNA_RNA within exon | Real-time PCR |
| 155_RNA_DNA | CAGTGGTGCCTTACATGGTG (SEQ ID NO: 480) | TGGGAAGGTAGAGGTTGTGG (SEQ ID NO: 681) | Lung | Both DNA_RNA within exon | Real-time PCR |
| nly | aaaagaatccaggagcgaga (SEQ ID NO: 481) | aacacccacaacatcttcca (SEQ ID NO: 682) | Lung | RNA only | Real-time PCR |
| y | aacttattgggttggcgaag (SEQ ID NO: 482) | ggacagacacacagcattcc (SEQ ID NO: 683) | Lung | RNA only | Real-time PCR |
| y | cagattttggctggtctgtg (SEQ ID NO: 483) | cactccaatgcaccacaaat (SEQ ID NO: 684) | Lung | RNA only | Real-time PCR |
| y | aaactgctcaggcataaccc (SEQ ID NO: 484) | catcaggcgacagattgaag (SEQ ID NO: 685) | Lung | RNA only | Real-time PCR |
| 598_RNA_only | AGGACCAGGTGTTTGTCCTG (SEQ ID NO: 485) | AGGTGTGGTGCAGACACTTG (SEQ ID NO: 686) | Lung | RNA only | Real-time PCR |
| 1019_CDS1_1 | TTGACTGTTCCACCACTTGTC (SEQ ID NO: 486) | TCTGATGCGCCAGTTTCTAA (SEQ ID NO: 687) | Lung | Both DNA_RNA within exon | Real-time PCR |
| 2735_CDS0_1 | GTGCCGGAAGTCATACTCAC (SEQ ID NO: 487) | GGCATTGCTGAAGGCTTTAC (SEQ ID NO: 688) | Lung | Both DNA_RNA within exon | Real-time PCR |
| 1594_CDS2_1 | CCAAAGATGTCTCTGCCTGA (SEQ ID NO: 488) | TCTGCCCTAGCCTGGTTTAC (SEQ ID NO: 689) | Lung | Both DNA_RNA within exon | Real-time PCR |
| 28954_CDS1_1 | CAGAAGGATGTCCCATCTGA (SEQ ID NO: 489) | CAGGCCAGACCAGTCTACAG (SEQ ID NO: 690) | Lung | Both DNA_RNA within exon | Real-time PCR |
| 598_CDS0_1 | GGCCTCAGTCCTGTTCTCTT (SEQ ID NO: 490) | TGGACAATGGACTGGTTGAG (SEQ ID NO: 691) | Lung | Both DNA_RNA within exon | Real-time PCR |
| 853661_CDS0_1 | CAGACTGCGACACCTGAGAC (SEQ ID NO: 491) | CTATGCAGAAAGGCAGGTGA (SEQ ID NO: 692) | Lung | Both DNA_RNA within exon | Real-time PCR |
| 4216_CDS0_1 | TTGCAAGAGTCCTGAATCTGA (SEQ ID NO: 492) | TGACATGCGTTTCATCTGTC (SEQ ID NO: 693) | Lung | Both DNA_RNA within exon | Real-time PCR |
| 10846_CDS15_1 | GCCGATACAGCTCGAGAATA (SEQ ID NO: 493) | CCAAGAGGTACTGGACTGGAAT (SEQ ID NO: 694) | Lung | Both DNA_RNA within exon | Real-time PCR |
| 3482_CDS11_1 | GGGAGACTCCTGTCGTCTGT (SEQ ID NO: 494) | GTGGAAAGGCTGGACAAGTT (SEQ ID NO: 695) | Lung | Both DNA_RNA within exon | Real-time PCR |
| 3660_CDS0_1 | GGAGATCTGCAGAGGGTAGAG (SEQ ID NO: 495) | TGGACAGCAACATTGAGAATC (SEQ ID NO: 696) | Lung | Both DNA_RNA within exon | Real-time PCR |
| 3839_CDS2_1 | CCGGCCATTATCAGAATGTT (SEQ ID NO: 496) | AGCAGAATGTAATACCACCGTTC (SEQ ID NO: 697) | Lung | Both DNA_RNA within exon | Real-time PCR |
| 84189_W_GENE_1 | TCCTGGAAGTTGAGTGGATG (SEQ ID NO: 497) | CTGGCAGCAACATCTTCAAT (SEQ ID NO: 698) | Lung | Both DNA_RNA within exon | Real-time PCR |
| 10326_CDS2_2 | AGTTGTTACCCGTGGGAAGT (SEQ ID NO: 498) | ACTCTGCGCTGTGCTATGAC (SEQ ID NO: 699) | Lung | Both DNA_RNA within exon | Real-time PCR |
| 845_CDS0_1 | GACACCGGCTCATGGTAGTA (SEQ ID NO: 499) | TATGATGGGAAGGACCGAGT (SEQ ID NO: 700) | Lung | Both DNA_RNA within exon | Real-time PCR |
| 25960_CDS3_1 | CATCACTCTGGCCTCATCAC (SEQ ID NO: 500) | TGTCTGTGCAGCAAGCATAA (SEQ ID NO: 701) | Lung | Both DNA_RNA within exon | Real-time PCR |
| 8749_CDS1_1 | TGAACCAGTAGAATCTTCAGCAAG (SEQ ID NO: 501) | GGAACTTTGTAGGGCTGGTCT (SEQ ID NO: 702) | Lung | Both DNA_RNA within exon | Real-time PCR |

TABLE 6-continued

Oligos

| Primer name | Forward Sequence | Reverse Sequence | Project | DNA only, RNA only or both | PCR, RT PCR, Sequencing |
| --- | --- | --- | --- | --- | --- |
| 65110_W_GENE_3 | TTCTCCCGTAGTTGGGAAAG (SEQ ID NO: 502) | AGAGTCTCAGGG1TGGCACT (SEQ ID NO: 703) | Lung | Both DNA_RNA_ within exon | Real-time PCR |
| 112399_CDS0_1 | AGAGGCCATCTTTGGATCTC (SEQ ID NO: 503) | TGCCCTCACTGAAGACTGAC (SEQ ID NO: 704) | Lung | Both DNA_RNA_ within exon | Real-time PCR |
| 84684_W_GENE_1 | ATTTCGAGGTTGGCCTTAGA (SEQ ID NO: 504) | ATTTCACTGTCCGCTCCTCT (SEQ ID NO: 705) | Lung | Both DNA_RNA_ within exon | Real-time PCR |
| 9054_exon3 | ATGCCATGCTCCCTTACCTA (SEQ ID NO: 505) | CTGACGAGCACGTTCCAT (SEQ ID NO: 706) | Lung | Both DNA_RNA_ within exon | Real-time PCR |
| 8904_exon1 | ATTTTGTGAAGCGGCGAAG (SEQ ID NO: 506) | GAACCCAGACCCCGAATTAC (SEQ ID NO: 707) | Lung | Both DNA_RNA_ within exon | Real-time PCR |
| 3351_N_GENE_1 | CTAGGGTCTVGGTGGCTTTG (SEQ ID NO: 507) | CCGGATCTCCTGTGTATGTG (SEQ ID NO: 708) | Lung | DNA only | Real-time PCR |
| 55023_CDS0_1 | TGCCCTATAGCTGTCAGTGTGT (SEQ ID NO: 508) | TAGTCGCTGCCTGAGAGTTG (SEQ ID NO: 709) | Lung | DNA only | Real-time PCR |
| 134728_CDS0_1 | AGCCTGTCTTGTTGCTGTG (SEQ ID NO: 509) | CTATTTGGCCTTCCCATTCT (SEQ ID NO: 710) | Lung | DNA only | Real-time PCR |
| bp_BC001767 |  | AAAAAACCCACCTACACGAT (SEQ ID NO: 711) | Lung | DNA only | Sequencing |
| bp_BC001767 |  | ATCTCGAAGCAGAACCAAGT (SEQ ID NO: 712) | Lung | DNA only | Sequencing |
| bp_BC001767 | AAGGACACTTATAGGCTTTT (SEQ ID NO: 510) |  | Lung | DNA only | Sequencing |
| bp_BC001767 | CGTGTAGGTGGGTTTTTTTTA (SEQ ID NO: 511) |  | Lung | DNA only | Sequencing |
| WHSC1L1_seq_f_1 | TGTGATCGCACTGACACGGC (SEQ ID NO: 512) |  | Lung | RNA only | Sequencing |
| WHSC1L1_seq_f_2 | GGTACCACAAACTGTGATTC (SEQ ID NO: 513) |  | Lung | RNA only | Sequencing |
| WHSC1L1_seq-f_3 | CCGAGAATATCATGTCCAGT (SEQ ID NO: 514) |  | Lung | RNA only | Sequencing |
| WHSC1L1_seq_f_4 | TGCGGCAAGCAGGAAATCCT (SEQ ID NO: 515) |  | Lung | RNA only | Sequencing |
| WHSC1L1_seq_f_5 | CCTCAACTGATGTAGAAAATGACTA (SEQ ID NO: 516) |  | Lung | RNA only | Sequencing |
| WHSC1L1_seq-f-6 | AGATATCCACAAAGCAAGTA (SEQ ID NO: 517) |  | Lung | RNA only | Sequencing |
| WHSC1L1_seq_f_7 | GTGGCCAGCAGAGATCTGCA (SEQ ID NO: 518) |  | Lung | RNA only | Sequencing |
| WHSC1L1_seq_f_8 | ACAAAGAGACTATACCCTGA (SEQ ID NO: 519) |  | Lung | RNA only | Sequencing |
| WHSC1L1_seq_f_9 | GAAGAGACGAAAGATCAAAA (SEQ ID NO: 520) |  | Lung | RNA only | Sequencing |
| WHSC1L1_seq_r_1 | TTGCTTTFTTCACTTAAATA (SEQ ID NO: 521) |  | Lung | RNA only | Sequencing |
| WHSC1L1_seq_r_2 | TAAGGCATAGGAGGTGGTAT (SEQ ID NO: 522) |  | Lung | RNA only | Sequencing |
| WHSC1L1_seq_r_3 | ATCACAGAGAGCAAATAGTC9 (SEQ ID NO: 523) |  | Lung | RNA only | Sequencing |

TABLE 6-continued

Oligos

| Primer name | Forward Sequence | Reverse Sequence | Project | DNA only, RNA only or both | PCR, RT PCR, Sequencing |
|---|---|---|---|---|---|
| WHSC1L1_seq_r_4 | ATGATCTCTGCATCAGGGTA (SEQ ID NO: 524) | | Lung | RNA only | Sequencing |
| WHSC1L1_seq_r_5 | CCTGGAAACGTTTTGCAGCT (SEQ ID NO: 525) | | Lung | RNA only | Sequencing |
| WHSC1L1_seq_r_6 | ACAATTCCAGCAGCCTTCTG (SEQ ID NO: 526) | | Lung | RNA only | Sequencing |
| WHSC1L1_seq_r_7 | GGAATGATTACTACAGATGAGA (SEQ ID NO: 527) | | Lung | RNA only | Sequencing |
| WHSC1L1_seq_r_8 | GCCCAGTTTTACATTCCATG (SEQ ID NO: 528) | | Lung | RNA only | Sequencing |
| WHSC1L1_seq_r_9 | TGTCTCTGTATGCTGAACTAG (SEQ ID NO: 529) | | Lung | RNA only | Sequencing |
| WHSC1L1_seq_r_10 | GGTGTAGAAATTATAAGCCT (SEQ ID NO: 530) | | Lung | RNA only | Sequencing |
| WHSC1L1_seq_r_11 | CGAATTTCAGTACTTGAGAG (SEQ ID NO: 531) | | Lung | RNA only | Sequencing |
| WHSC1L1_seq_r_12 | TTGCTGGCTTGTTTGGTTGC (SEQ ID NO: 532) | | Lung | RNA only | Sequencing |
| WHSC1L1_seq_r_13 | TCCTCTTTTAGTACTGGTTC (SEQ ID NO: 533) | | Lung | RNA only | Sequencing |
| WHSC1L1_seq_r_14 | TCTTTGGAATCACACAGTTTGT (SEQ ID NO: 534) | | Lung | RNA only | Sequencing |
| WHSC1L1_seq_r_15 | CTGGCCACCATCTTCAGCAA (SEQ ID NO: 535) | | Lung | RNA only | Sequencing |
| LETM2_seq_f_1 | GCCTTCTACAGTTATAATTCAG (SEQ ID NO: 536) | | Lung | RNA only | Sequencing |
| LETM2_seq_f_2 | GAGGAACAGAGCCAAGATGG (SEQ ID NO: 537) | | Lung | RNA only | Sequencing |
| LETM2_seq_f_3 | GACTGATATTCTTGTGGAAT (SEQ ID NO: 538) | | Lung | RNA only | Sequencing |
| LETM2_seq_r_1 | AATTCAGTTCTGGCTATTGC (SEQ ID NO: 539) | | Lung | RNA only | Sequencing |
| LETM2_seq_r_2 | AGGAACAGAGCCAAGATGGG (SEQ ID NO: 540) | | Lung | RNA only | Sequencing |
| LETM2_seq_r_3 | TCTTGTGGAATTACCTACTT (SEQ ID NO: 541) | | Lung | RNA only | Sequencing |

TABLE 7

List of high-confidence MCRs in lung AC and SCC primary tumors and cell lines.

| Cytogenetic band | Minimal common regions (MCRs) | | | | MCR recurrence | | | | Cancer-related genes | miRNA |
|---|---|---|---|---|---|---|---|---|---|---|
| | Position (Mb) | Size (Mb) | Max/Min value | No. of transcripts | Gain/Loss | | Amp/Del | | | |
| | | | | | % T | C | T | C | | |
| Gain and amplification | | | | | | | | | | |
| 1p36.32-1p36.32 | 2.37-2.47 | 0.1 | 1.2 | 2 | 22 | 9 | 9 | 3 | 0 | |
| 1p36.21-1p36.12 | 15.29-20.69 | 5.4 | 1.32 | 86 | 20 | 8 | 9 | 1 | 1 | SDHB, PAX7 |
| 1p34.3-1p34.3 | 37.82-38.13 | 0.32 | 2.92 | 11 | 18 | 7 | 8 | 1 | 1 | |

TABLE 7-continued

List of high-confidence MCRs in lung AC and SCC primary tumors and cell lines.

| Cytogenetic band | Minimal common regions (MCRs) | | | No. of transcripts | MCR recurrence | | | | | Cancer-related genes | miRNA |
|---|---|---|---|---|---|---|---|---|---|---|---|
| | Position (Mb) | Size (Mb) | Max/Min value | | Gain/Loss | | Amp/Del | | | | |
| | | | | | % | T | C | T | C | | |
| 1p34.2-1p34.1 | 41.65-44.9 | 3.26 | 2.35 | 50 | 19 | 6 | 10 | 3 | 2 | | |
| 1q21.3-1q22 | 150.95-151.92 | 0.98 | 1.96 | 29 | 49 | 17 | 24 | 3 | 13 | | |
| 1q31.2-1q32.1 | 189.28-197.57 | 8.29 | 1.22 | 35 | 40 | 16 | 17 | 1 | 4 | | hsa-mir-181b-1, hsa-mir-213 |
| 1q32.2-1q32.2 | 206.17-206.24 | 0.06 | 1.05 | 3 | 39 | 15 | 17 | 1 | 4 | | |
| 2p16.3-2p14 | 49.1-64.73 | 15.63 | 1.11 | 54 | 40 | 13 | 21 | 1 | 3 | BCL11A, REL | hsa-mir-217, hsa-mir-216 |
| 2q11.2-2q11.2 | 96.68-96.95 | 0.27 | 2.16 | 8 | 35 | 14 | 16 | 4 | 4 | | |
| 2q14.1-2q14.2 | 118.58-120.16 | 1.57 | 0.88 | 11 | 28 | 9 | 14 | 1 | 2 | | |
| 2q31.1-2q31.1 | 170.19-170.32 | 0.13 | 1.14 | 4 | 28 | 11 | 13 | 1 | 1 | | |
| 3p12.1-3p11.1 | 87.07-88.45 | 1.38 | 1.32 | 8 | 17 | 6 | 8 | 1 | 1 | | |
| 3q11.2-3q12.3 | 95.26-103.06 | 7.8 | 0.82 | 43 | 33 | 15 | 12 | 2 | 1 | TFG | |
| 3q21.3-3q25.32 | 130.02-159.3 | 29.28 | 0.85 | 182 | 45 | 21 | 17 | 6 | 4 | GMPS | |
| 3q29-3q29 | 195.34-196.56 | 1.22 | 1.06 | 12 | 36 | 16 | 14 | 6 | 3 | | |
| 4q12-4q12 | 53.58-55 | 1.42 | 1.47 | 6 | 22 | 9 | 10 | 1 | 4 | FIP1L1, CHIC2 | |
| 4q13.3-4q13.3 | 75.33-76.03 | 0.7 | 0.92 | 6 | 17 | 7 | 7 | 2 | 1 | | |
| 4q21.1-4q21.1 | 77.09-78.06 | 0.97 | 0.85 | 13 | 14 | 5 | 7 | 1 | 1 | | |
| 5p15.33-5p15.33 | 0.53-0.92† | 0.38 | 2.67 | 5 | 60 | 27 | 24 | 6 | 15 | | |
| 5p12-5p12 | 42.76-43.48 | 0.73 | 2.69 | 9 | 52 | 23 | 20 | 3 | 13 | | |
| 5q31.3-5q31.3 | 140.55-140.66 | 0.12 | 1.99 | 11 | 19 | 6 | 10 | 2 | 4 | | |
| 6p25.2-6p24.3 | 2.96-8.04 | 5.09 | 1.59 | 33 | 39 | 16 | 16 | 2 | 2 | | |
| 6p22.3-6p22.3 | 17.87-20.56 | 2.69 | 1.59 | 9 | 36 | 15 | 15 | 2 | 3 | DEK | |
| 6p22.1-6p22.1 | 27.95-28.47 | 0.52 | 0.91 | 24 | 33 | 13 | 14 | 1 | 1 | | |
| 6p12.3-6p12.2 | 49.91-52.16 | 2.25 | 1.21 | 6 | 35 | 13 | 16 | 2 | 2 | | hsa-mir-206, hsa-mir-133b |
| 6p12.1-6p12.1 | 53.47-55.73 | 2.26 | 1.21 | 11 | 35 | 13 | 16 | 3 | 2 | | |
| 6q24.3-6q25.1 | 145.99-149.77 | 3.79 | 1.16 | 11 | 17 | 6 | 8 | 2 | 1 | | |
| 6q25.2-6q25.2 | 153.38-154.67 | 1.28 | 1.68 | 5 | 16 | 5 | 8 | 1 | 1 | | |
| 7p11.2-7p11.2 | 54.41-55.94 | 1.53 | 3.62 | 15 | 36 | 13 | 18 | 2 | 7 | EGFR | |
| 7q21.3-7q21.3 | 93.2-95.37† | 2.17 | 1.96 | 13 | 40 | 11 | 22 | 2 | 7 | | |
| 7q21.3-7q22.1 | 97.13-98.66† | 1.54 | 1.96 | 17 | 40 | 10 | 23 | 2 | 7 | | |
| 7q31.2-7q31.2 | 115.22-116.9 | 1.68 | 2.15 | 10 | 34 | 10 | 18 | 2 | 7 | MET | |
| 8p12-8p11.22* | 38.24-38.45*† | 0.21 | 1.98 | 2 | 35 | 17 | 12 | 6 | 4 | WHSC1L1, FGFR1 | |
| 8q11.21-8q22.1 | 48.86-97.23† | 48.37 | 1.42 | 192 | 52 | 19 | 24 | 5 | 11 | NCOA2, NBSI, CBFA2T1 | hsa-mir-124a-2 |
| 8q24.13-8q24.13 | 123.37-126.14† | 276 | 0.9 | 23 | 54 | 21 | 24 | 4 | 9 | | |
| 8q24.21-8q24.21 | 128.5-129.02† | 0.52 | 4.36 | 3 | 59 | 22 | 27 | 4 | 14 | MYC | |
| 8q24.3-8q24.3 | 145.67-146.25 | 0.58 | 0.81 | 21 | 52 | 20 | 23 | 4 | 8 | RECQL4 | |
| 10q24.1-10q24.1 | 97.62-98.11 | 0.49 | 1.15 | 8 | 16 | 3 | 10 | 1 | 1 | | |
| 10q26.3-10q26.3 | 135.24-135.24 | 0.01 | 1.28 | 1 | 11 | 1 | 8 | 1 | 3 | | |
| 11p14.2-11p14.1 | 26.54-28 | 1.46 | 0.95 | 13 | 20 | 7 | 10 | 1 | 1 | | |
| 11p13-11p13 | 31.76-34.08 | 2.32 | 2.84 | 21 | 23 | 9 | 10 | 1 | 1 | WT1, LMO2 | |
| 11q13.3-11q13.3 | 69.3-69.99 | 0.69 | 3.46 | 8 | 37 | 11 | 21 | 3 | 6 | | |
| 11q22.1-11q22.2 | 99.73-102.15 | 2.41 | 0.94 | 16 | 27 | 9 | 13 | 1 | 3 | BIRC3 | |
| 12p13.33-12p13.33 | 0.17-0.81 | 0.64 | 1.09 | 7 | 36 | 12 | 18 | 1 | 6 | | |
| 12p13.2-12p12.3 | 12.37-16.6 | 4.22 | 1.16 | 39 | 29 | 11 | 13 | 2 | 5 | | |
| 12p12.1-12p11.23 | 24.61-26.95† | 2.34 | 1.98 | 13 | 37 | 15 | 16 | 5 | 7 | KRAS2 | |
| 12q12-12q13.11 | 43.74-46.42 | 2.68 | 2.68 | 14 | 31 | 11 | 15 | 2 | 6 | | |
| 12q13.2-12q13.2 | 54.72-54.84 | 0.12 | 1.4 | 8 | 29 | 10 | 14 | 2 | 2 | ERBB3 | |
| 12q15-12q15 | 67.42-67.95 | 0.53 | 1.82 | 5 | 34 | 14 | 14 | 5 | 4 | | |
| 13q32.1-13q32.1 | 94.07-95.21 | 1.14 | 1.03 | 6 | 6 | 3 | 2 | 1 | 1 | | |
| 13q34-13q34 | 111.77-112.97† | 1.2 | 1.21 | 16 | 14 | 4 | 8 | 2 | 5 | | |
| 13q34-13q34 | 113.25-114.11 | 0.86 | 1.12 | 10 | 14 | 4 | 8 | 1 | 5 | | |
| 14q13.2-14q13.3 | 34.64-36.22† | 1.58 | 2.23 | 20 | 29 | 9 | 15 | 2 | 4 | | |
| 14q22.2-14q22.3 | 53.49-55.15 | 1.66 | 1.41 | 22 | 30 | 8 | 17 | 1 | 6 | | |
| 14q32.13-14q32.13 | 93.66-94.03 | 0.37 | 1.1 | 9 | 29 | 6 | 18 | 1 | 4 | | |
| 15q25.2-15q25.3 | 82.35-83.48 | 1.13 | 0.95 | 22 | 31 | 10 | 16 | 2 | 5 | | |
| 16p12.1-16p12.1 | 23.68-27.37 | 3.69 | 0.89 | 21 | 18 | 6 | 9 | 1 | 2 | | |
| 16q12.1-16q12.2 | 51.03-52.87 | 1.84 | 1.3 | 9 | 20 | 7 | 10 | 1 | 4 | | |
| 16q22.2-16q22.2 | 69.62-69.87 | 0.26 | 1.08 | 2 | 18 | 6 | 9 | 1 | 4 | | |
| 16q24.2-16q24.3 | 86.43-87.23 | 0.81 | 1.7 | 9 | 18 | 5 | 10 | 2 | 3 | | |
| 17p11.2-17p11.2 | 17.09-18.86 | 1.77 | 0.84 | 40 | 20 | 7 | 10 | 1 | 1 | | |
| 18p11.32-18p11.32 | 0.2-0.9 | 0.7 | 1.7 | 9 | 25 | 13 | 9 | 4 | 1 | | |
| 18q11.2-18q11.2 | 18.25-20.9† | 2.65 | 0.96 | 15 | 20 | 8 | 9 | 2 | 0 | | |
| 18q12.1-18q12.1 | 26.83-27.31 | 0.48 | 1.55 | 6 | 19 | 9 | 7 | 2 | 1 | | |
| 18q12.3-18q21.1 | 37.92-46.03 | 8.12 | 1.41 | 33 | 23 | 11 | 8 | 1 | 1 | | |
| 19p13.12-19p13.12 | 14.8-16.01 | 1.22 | 1.53 | 39 | 11 | 5 | 4 | 1 | 1 | BRD4 | |
| 19q12-19q12 | 35.01-35.73 | 0.73 | 1.91 | 4 | 31 | 13 | 13 | 2 | 5 | | |
| 19q13.33-19q13.33 | 55.52-55.68† | 0.16 | 1.01 | 8 | 17 | 5 | 9 | 1 | 1 | | |
| 20p12.3-20p12.2 | 7.91-10.57 | 2.66 | 0.85 | 12 | 31 | 13 | 14 | 1 | 3 | | |

TABLE 7-continued

List of high-confidence MCRs in lung AC and SCC primary tumors and cell lines.

| Cytogenetic band | Minimal common regions (MCRs) Position (Mb) | Size (Mb) | Max/Min value | No. of transcripts | MCR recurrence Gain/Loss % | T | C | Amp/Del T | C | Cancer-related genes | miRNA |
|---|---|---|---|---|---|---|---|---|---|---|---|
| 20q11.21-20q11.21 | 29.66-29.88† | 0.22 | 3.85 | 5 | 42 | 13 | 23 | 1 | 8 | | |
| 20q13.32-20q13.33 | 57.04-60.21† | 3.17 | 1.61 | 19 | 41 | 12 | 23 | 1 | 11 | SS18L1 | |
| 21q11.2-21q21.1 | 14.52-18.56 | 4.04 | 1.14 | 13 | 17 | 7 | 7 | 2 | 0 | | hsa-mir-99a, hsa-let-7c, hsa-mir-125b-2 |
| 22q11.21-22q11.21 | 19.09-20.3 | 1.22 | 1.02 | 28 | 25 | 11 | 10 | 1 | 3 | | |
| | | | | Loss and deletion | | | | | | | |
| 1p22.1-1p22.1 | 92.45-94.07 | 1.62 | −0.89 | 15 | 18 | 9 | 7 | 1 | 1 | | |
| 2q34-2q35 | 209.15-217.17 | 8.02 | −0.83 | 25 | 11 | 6 | 3 | 1 | 1 | AT1C | |
| 2q36.1-2q37.1 | 223.74-230.87 | 7.12 | −1.03 | 28 | 8 | 5 | 2 | 1 | 1 | | |
| 3p26.3-3p26.2 | 0.43-3.09 | 2.66 | −0.87 | 4 | 23 | 11 | 9 | 1 | 3 | | |
| 3p11.2-3p11.1 | 87.39-88.45 | 1.07 | −0.92 | 6 | 24 | 14 | 7 | 3 | 1 | | |
| 4p15.32-4p15.32 | 15.84-17.48 | 1.64 | −0.88 | 8 | 14 | 8 | 5 | 2 | 0 | | |
| 6p21.32-6p21.32 | 32.47-33.01 | 0.54 | −1.05 | 17 | 11 | 3 | 6 | 2 | 1 | | |
| 6q21-6q22.33 | 111.4-128.94† | 17.55 | −1 | 72 | 23 | 8 | 11 | 1 | 4 | | |
| 7p22.3-7p22.3 | 1.36-2.05 | 0.69 | −1.21 | 7 | 10 | 5 | 3 | 1 | 1 | | |
| 7q34-7q34 | 142.28-142.44 | 0.16 | −1.39 | 4 | 13 | 7 | 4 | 2 | 1 | | |
| 8p21.1-8p12 | 28.74-33.48† | 4.74 | −1.28 | 22 | 36 | 15 | 16 | 1 | 8 | WRN | |
| 9p21.3-9p21.3 | 21.47-22† | 0.53 | −4.81 | 4 | 43 | 16 | 21 | 1 | 18 | CDKN2A | hsa-mir-31 |
| 11q11-11q11† | 55.1-55.18 | 0.08 | −4.06 | 2 | 23 | 13 | 6 | 7 | 1 | | |
| 11q24.3-11q24.3 | 128.13-129.24 | 1.11 | −0.84 | 9 | 16 | 5 | 8 | 1 | 4 | | |
| 12q12-12q13.11 | 42.41-44.87† | 2.46 | −1.94 | 13 | 7 | 2 | 4 | 1 | 2 | | |
| 13q12.11-13q12.11 | 19.14-19.56 | 0.41 | −3.51 | 5 | 34 | 14 | 14 | 1 | 7 | | |
| 13q14.13-13q21.1 | 45.82-57.2 | 11.38 | −1.35 | 60 | 35 | 16 | 13 | 1 | 8 | RB1 | hsa-mir-16-1, hsa-mir-15a |
| 13q32.2-13q32.2 | 97.47-97.9 | 0.42 | −3.25 | 3 | 29 | 13 | 11 | 1 | 8 | | |
| 18q21.33-18q22.2 | 58.4-65.82† | 7.43 | −1.26 | 26 | 29 | 10 | 14 | 1 | 5 | | |
| 21p11.2-21p11.1 | 9.93-10.08† | 0.15 | −1.33 | 3 | 17 | 9 | 6 | 1 | 1 | | |

The numbers of primary tumors (T) or cell lines (C) with gain or loss and amplification or deletion are listed, respectively See text for other definitions MCR recurrence is denoted as the percentage of the total dataset In bold are the MCRs verified by RT-PCR and FISH (FIGS. 2 and 7-10, data not shown) Black diamonds identify high-priority MCRs that are in common with the PDAC dataset (1). The short arm of chromosome 3 was consistently lost across several primary tumors and cell lines (FIGS. 1 and 6) Three smaller regions within the short arm of chromosome 3 were identified by the automated locus definition program, based on the presence and recurrence of deletions in a subset of samples (FIG. 6, bright green bars). The number of transcripts is based on Build 35, National Center for Biotechnology Information Only the known genes within the boundaries have been included The list of cancer-related genes was derived from Futreal et al. (3)
*MCR in 8p, which was subject to further fine mapping (see text)
†The MCR at 11q11 has recently been shown by Sebat et al (2) to be a copy-number polymorphism (ORF5I1 on chromosome 11q11)
1. Aguirre, A J., Brennan, C., Bailey, G, Sinha, R, Feng, B, Leo, C, Zhang, Y., Zhang, J., Gans, J. D, Bardeesy, N, et al. (2004) Proc. Natl. Acad. Sci USA 101, 9067-9072
2. Sebat, J., Lakshmi, B., Troge, J, Alexander, J, Young, J., Lundin, P., Maner, S, Massa, H., Walker, M., Chi, M., et al. (2004) Science 305, 525-528.
3. Futreal, P. A., Coin, L., Marshall, M., Down, T, Hubbard, T, Wooster, R., Rahman, N & Stratton, M. R. (2004) Nat. Rev Cancer 4, 177-183

TABLE 8

| Affymetrix Probe | Cytogenetic band | Position | NCBI Gene Name | Gene full name |
|---|---|---|---|---|
| 209863_s_at | 3q28 | 190, 831, 918 | TP73L | tumor protein p73-like |
| 211194_s_at | 3q28 | 190, 831, 918 | TP73L | tumor protein p73-like |
| 211195_s_at | 3q28 | 190, 831, 918 | TP73L | tumor protein p73-like |
| 218182_s_at | 3q28 | 191, 506, 196 | CLDN1 | claudin 1 |
| 222549_at | 3q28 | 191, 506, 196 | CLDN1 | claudin 1 |
| 1552291_at | 3q29 | 197, 927, 625 | PIGX | phosphatidylinositol glycan, class X |
| 202514_at | 3q29 | 198, 258, 815 | DLG1 | discs, large homolog 1 (*Drosophila*) |

TABLE 9

Markers of the Invention displaying increased expression in Lung Cancer Primary Tumors.

| Gene Symbol | Chromosome | Entrez ID |
|---|---|---|
| (A) | | |
| NPC1 | 18 | 4864 |
| BRD9 | 5 | 65980 |
| CHCHD2 | 7 | 51142 |
| CAS1 | 7 | 64921 |
| BRI3 | 7 | 25798 |
| TMEM16F | 12 | 196527 |
| AMIGO2 | 12 | 347902 |
| MBC2 | 12 | 23344 |
| NIT2 | 3 | 56954 |
| RG9MTD1 | 3 | 54931 |
| TRRAP | 7 | 8295 |
| RAB2 | 8 | 5862 |

TABLE 9-continued

Markers of the Invention displaying increased expression in Lung Cancer Primary Tumors.

| Gene Symbol | Chromosome | Entrez ID |
|---|---|---|
| RNF139 | 8 | 11236 |
| NDUFB9 | 8 | 4715 |
| SPC18 | 15 | 23478 |
| RIOK3 | 18 | 8780 |
| CPOX | 3 | 1371 |
| ASNS | 7 | 440 |
| PSMA6 | 14 | 5687 |
| GCH1 | 14 | 2643 |
| LCMT1 | 16 | 51451 |
| ATP5E | 20 | 514 |
| PSMA7 | 20 | 5688 |
| HTPAP | 8 | 84513 |
| PON2 | 7 | 5445 |

(B)

| Gene Symbol | Chromosome | Entrez ID |
|---|---|---|
| Whsc1l1 | 8 | 54904 |
| Brd4 | 19 | 23476 |
| ss18l1 | 20 | 26039 |
| CAMK1G | 1 | 57172 |
| CNNM4 | 2 | 26504 |
| CNNM3 | 2 | 26505 |
| PPIG | 2 | 9360 |
| tpx2 | 20 | 22974 |
| BRD9 | 5 | 65980 |
| SEMA4C | 2 | 54910 |
| CCNI | 4 | 10983 |

SEQUENCE LISTING (848 sequences)

SEQ ID NO: 1 - DNA, 1709 bp, Homo sapiens
attttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagtaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccac

SEQ ID NO: 2 - DNA, 1677 bp, Homo sapiens
atgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaaaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatag

SEQ ID NO: 3 - DNA, 3442 bp, Homo sapiens
cgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtttgaatgaacagcgctcccacctccagtcctggcatccgctgggggcgctgttctttagctagtgccagtattaaaacattgtcatt

SEQ ID NO: 4 - DNA, 1014 bp, Homo sapiens
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctccaactccactaagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggagcggcttcagcttcgacttcatctttacccaaaagagtggactctga

SEQ ID NO: 5 - DNA, 957 bp, Homo sapiens
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaaatgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgtcgttcctcaaggtgtgggacaccttga

SEQ ID NO: 6 - DNA, 2788 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 7 - DNA, 911 bp, Homo sapiens
atggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatgctggcttggctccgtttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagccggagtgtacttcactgacacctatggggacagagaccggttcaaggtctctaagaaggtgcccaagatcccactccatgtcagttttgttgctgttgttgaagacaccagctactctttgttgaacagtttacttcagtctggactttgaaagtagacctcaaggaagtcagggaatgagccatgtgtgcatctgtgggaggaggattccaggcacagtgaagcgcaatggtgaaaacctggaaaggcaaattgattgccttcctgtggtatcatttaatatgggggtaccagtccatggcctgttaggaaccagaacacacagcaggatgtgagcagcgggtgagcaaataaagcttcatctgtatttac

SEQ ID NO: 8 - DNA, 2400 bp, Homo sapiens
gacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaaaaaaaaaaaaaaaaaaaaaaaaaaaaaaa

SEQ ID NO: 9 - DNA, 2289 bp, Homo sapiens
gtgtccctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaa

SEQ ID NO: 10 - DNA, 1830 bp, Homo sapiens
ggtcaggagcccgagattcgccgcctgccctcgcccgagcccgggggcccaagctgcggcagcggctcccaacgcctctgctcgaggagagcggcggcctggatgccccagcgccctccctgtccagttccttgaaggcccccaagaggggcgaggccggggaggtgctggagcggggccaagtgagctttcggggccgcggttgaactggagtcttgagtgcgctgcggtcagtggaggcccttccaccctcgccgcgccccgtggggaatagtcccccacctcccgccatggctgcagcaggaggagacgacgtcctccattttgtcgggacaactgtgggaacttgggacccctcaaaaccaaaccccgtggggccaggacttgtcccggaagccccgactgggctctgccattcggacaagggaacagccccagctgccggcgtctgcgtccgcggggcagtactggtcgggcgcgacggtggagacacccagacgcagctccccgcctccatcaaccaagatggagggagctgcaggctcccttggagctgggctctcgcgggttggaggggctgaggcctgccctggggcgtccctgggcgccgccgtcctgtgctagcagcccggggcgctggccctgcctaggcctttttactgcctgccaccgtctcctggtccggaatggttgatggagactccatggaggctccctccacagcccgctctatcgcggggcgcacccgctgcggcccctgcggggagcagaatcagggacagatggcgcccggtgagggcgggccccacaggccacctccacgaggggtcttctcttttgttcctcgtctacacctacgtcttcggcggatgtcatggtgctgaaccatttcccggactccacgtaaagatggaagcgattccgctttcgtctcgccctggcggttcttagtgggattacaattgaggatgttagtttggatgaaagttggtgaaatacttaccttatgtctggaaatacagataatgtgatttttaaaaaacacattgagccccgttttacttctgtggtatggtaaaggcacaggtttattcaatgaaaatcagacgttaaccatctaatgcaggggtggccaatcttttggcttcccggggccacattggaagaattggcttgggccacacataaaatacgctaacagtaacaatagctgatgagctaaaacaaacgaaaaaaccaaaacgccaaaaaaatctcataacgttttaagaaaatttacaaatatgtgttgggctgcattcaaagccgtcctgggccgcatgcaacccccaagggctgcaggttggacaagcttgatctaagacaaaagcatgttcacggattgatgagagttctgtgtaagcctttgcatattgcatagtgctgtatgtcatggatatgcctaatatcacctacattttttaggtcctcagttactctttggaaataagtgaattacatgtaatgtcatcattttaatgactgctgtaaattacaagcactgactaccctgagttcgtggagaagggctccatagagaaaatttgaaggtctgacagaaactttaaatggtaagctcagtagccacttgtcatctattttctgattatctttttcacaattttttggcattgatactgttcaaagattaaaattgggtaacatttctttttcctgatagtggcaggaatgacaggttcatgtcccaatgaaaacgctcacctcagtatgctgccatgatttcgagggttgtcgaaaatttaggaaaaaaaagtcttcattgttcaacaa

SEQ ID NO: 11 - DNA, 933 bp, Homo sapiens
atgcagcaaaataacagtgtgcctgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaacaccctttctcaatccactcatctacacactgaggaatgcagaagtgaaaaatgccatgagaaagttatggcatggcaaaattatttcagaaaacaaaggataa

SEQ ID NO: 12 - DNA, 1891 bp, Homo sapiens
gtctctggtatctcccgctgagctgctctgttcccggcttagaggaccaggagaagggggagttggaggctggagcctgtaacaccgtggctcgtctcgctctggatggtggtggcaacagagatggcagcgcagctggagtgttaggagggcggcctgagcggtaggagtggggctggagcagtaagatggcggccggagcagtaagatggcggctggagtggtttttctggcattgtctgcccagctgctccaagccaggctgatgaaggaggagtcccctgtggtgagctggaggttggagcctgaagatggcacagctctcgatgtgcattttgtaagcactttggagccactatcaaatgctgtgaagagaaatgtacccagatgtatcattatccttgtgctgcaggagccgacacctttcaggatttcagtcacatcttcctgctttgtccagaacacattgaccaagctcctgaaagatcgaaggaagatgcaaactgtgcagtgtgcaacagcccaggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaacgaattatgaaatctgtaccaaccaacggctggaaatgcaaatgaataccgaattggaaaaacagatttctaatgaggctgatagtgaagaaatgaaaatgtcttctgaagtgaagcatatttgtggcgaagatcaaattgaagataaaatggaagtgacagaaaacattgaagtcgttacacaccagatcactgtgcagcaagagcaactgcagttgttagaggaacctaaaacagtggtatccaaagaagaatcaaggcctccaaaatttgtcattgaatctgtcactcttccactagaaaccttagtgtccccacaggaggaaagctcttcattatgtcctgaggaacagttggttatagaaaggctacaaggagaaaaggaacagaaagaagattctgaactttctactggattgatggactctgaaatgactcctacaattgagggttgtgtgaaagatgtttcataccaaggaggcaaatctataaagttatcatctgagacagagtcgtcattttcattatcagcagacataagcaaggcagatgtgtcttcctccccaacaccttcttcagacttgccttcgcatgacatgctgcataattacccttcagctcttagttcctctgctggaaacatcatgccaacaacttaacatctcagtcactccaaaaattggcatgggtaaaccagctattactaagagaaaattttctcctggtagacctcggtccaaacaggaggcttggagtacccataatacagtgagcccaccctcgtggtccccagacatttcaggaggtcgggaaatttttaaacccaggcagcttcctggcagtgccatttggagcacaaaagtgggccgtgggtctggatttccaagaaagcggagacctcgaggtgcaggactgtcggggtgaggtggccgaggcaggtcaaagctgaaaagtggaattggagctgttgtattgcctggggtgtctactgcagatatttcatcaaataaggatgatgaagaaaactctatgctcgatatggttgtgttgttttctagcagtgacaagttcactttgaatcaggatatgtgtgtagtttgtggcagttttggccaaggagcagaaggaggattacttgcctgttctcagtgtggtcagt

SEQ ID NO: 13 - DNA, 3234 bp, Homo sapiens
gctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcgctgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaa

SEQ ID NO: 14 - DNA, 1225 bp, Homo sapiens
actccctgagcacaggcctctgatgtcatttcctgacctgcctccccctccccgcccgacccgcgggtgcccgagatctgactcaccgtccccctccgggcttagccggcggaggtggggcgggtgccgccgaggtagccacgcagcccctgtgcgcctccggcccggcccagcgacctcctctcgggcctgccgttacccggtcccctcctgccaccacccgctacccggccaccccgagtccgcctggggtggccgaacgtatggagctgggctccagggtgcacggggatggggggtgaggagcggggcgttctccctcccagcaccccccagctgactctgtgcccggagggggtgtgtgagccggaacctccagcattcttggggatacgaacttccaacgctgggcagcctcttaaggcttctaggaattcgcatccccagcgccccagccagcagatcggttgcgagagggaccgttcgggtccgcggggccgggaatggaggtgggagggcggggccgaggcggcggccgcctgcggactggagacccgggaggacggacgcggacgcgggctgctcgtcttttacggcccttcaacgcccaccacgacccactcctcttggagaccccgggcgacggtggggctcttgggcattctgagactgcgcttggtggagaccccgggcgacggtggagctcttgggcattctgagactgcgcttggtggagccccctactggccagactggatttctcagcctgcgactcagccccaggctacacgaaagaagccagacctggcttttactgcctcctgaggccttcgtcttgttcacactgagtgtccagtccctccaaatccggctacactctactggcaaggagcacctgggccatgttttagagatcatccgaggactaaccccaaaagtttatgaagagaaagcagaggccgagctgaagagatggacccgggtcacacccaggtaaaggcaggatctaaactgaaactggtgtcagatctggttgccttgcacccctgatatcaggtgaagcaacactgggcaggatagagcagagtgaggtcagagtgtgaagatccagcctgatgcccaaactgacgcctcttcattctcccctgctccatctgtaaacgtcacggttaatccatctactttattgcattatatagagaaataaatgaaatgtcatagctgt

SEQ ID NO: 15 - DNA, 591 bp, Homo sapiens
cttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttaaaaaaaaaaaaaaa

SEQ ID NO: 16 - DNA, 924 bp, Homo sapiens
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacagtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcctagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgtttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcacagctcctgttgttggcaaggggcttctgggtggcctga

SEQ ID NO: 17 - DNA, 1502 bp, Homo sapiens
ccagtaatccattcctcgccccagggaaactcctgccttttgggaatgtgtctcctggggtcaactgtgcacacaggctagtgtgcatggggagccaggccagcactatggggacctgattgagagagaggttgatggcaatctcctgctaacagttctcaacctctcacaggtgtcacatagaatgggcatcaagtgcaatgggtaactacagcattgtcagggagtttgtgctcctgggattttcttttttttttttttttttaattgatcattcttgggtgtttctcgtggagggggatttggcagggtcataggacaatagtggagggaaggtcagcagataaacaagtgaacaaaggtctctggttttcctaggcagaggagctccttggattttcttatctccatgagttccaggttctgctgtttgctctgatcctgttgatatatgtgctgatgctgctgggcaacctggccatcatcagcttcatttgccttgattcccgccttcactcacccatgtacttcttcctctgcaacttctccctcatggagatggtggtcacctccactgtggtacataggatgctggcagacctgctatccactcacaagaccatgtccctggccaaatgcctaacccagtctttcttttacttctccctgggctctgccaacttcctgatactcatggtcatggcctttgatcgctacgtggccatctgccaccccctgcgctacccaaccatcacgaatggtccagtgtgtgtgaagctggtggtggcctgttgggtggttggtttcctctccattgtctctcccacactgcagaaaacacgactctggttctgtggccctaacatcatcggccactacttctgtgactctgccccgctgctcaagcttgcctgctctgacacccgccacattgagcgcatggacctcttcctgtccctgctctttgtgctgaccaccatgctgcttatcatcctctcctacatcctcattgtggctgcagtgctgcacatcccttcctcctctggatgccagaaggccttctccacctgtgcctctcacctcacagtggtggttctgggctatggcagtgccatcttcatctacgtgaggccaggcaagggccactccacatacctcaacaaggcggtggccatggtgactgcaatggtaacccctttcctcaaccccttcatcttcaccttccggaatgagaaggtcaaggaggtcattgaggatgtgactaaaaggatcttccttggagacccagcagcctgtaggtgagagggtgagcccttgacagggctagagagcacctgacaagtcacgaggagtagacttgctgcaggtgggcacccacatgcctaagctggagctcctcactctcttttttctcattttctcctggtccctcatcttcatgcaagtttcttctcctgcactgcagagaactaatggacacacattggtagaatgtctcaaag

SEQ ID NO: 18 - DNA, 1622 bp, Homo sapiens
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 19 - DNA, 2955 bp, Homo sapiens
ggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatgctggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagccggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgggagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgtt

SEQ ID NO: 20 - DNA, 5862 bp, Homo sapiens
ggggggggggcggggccggctctttatttacctttgacgcggggagggaagagaggcgcctcctaatccatcttctccctccagcttctgcctggctaccgcccctgacccccacccaggcacccactccactctcgccgctcagcgaattcatccggccctctcccaccccctcccccattcttcccctttccaactcccaatttctcccgcctacacctcccggtgacctcaggctgagagaataattcgtattattattacaaacaaactcactctccagaagcctgatttccctgagacccggtttatttccatggataccccctcctcctctgctttcaccccttctccgcggctctctccctccccgctgccccccacagctctgactcagctctccgtctctcacaaaggccacctcccgctcccctctcccccgcaccccgccctcccctgtctcccttctcctcaggctcttctccacctgccccattcctgctgtgtccggagggccatctttcctcttttcccccagtcaccaccccgcggagccccaggggacagcaggccaactttggagggtcctccctcctcagtccggttcaccacaagccccttcctttcccccagccctgctgatgtgctgaatgcctcctcgtgcccagccccattcaatgctccccttcccaaaaatggagccgacccctaaactcacaattgtaaaacctcatgagtataaagggcctgtacggtcagatggttcaggcagccatctgctgcttgaatagtccctttatgaagacccaagcagttcttccgcaagatctccggggcaccatcctgccctcagtccaggagtctccctccaccaggagctctggcccggctgtaacaaggaccctccttcccctgagtcctgcagtttcccactcagccctcagaccctgtccacccctcccaccatcttctgtcttctctctgacttgaattcctattttcttaattcctattttaaaaagttctcttttctcctcctgctcaccagcttccctccactttaatccatcacttctctccccacagtcaggtgaaatgcctccagctcacccttggtttctctgctcactgtttttgggaggacacacccaactccttgctatccaactcctgcctcgattcccaggaagtcctcttccagtcagtcagactcatggactcttaggaagggcccaccgggggagacacatcccttccaccctaagcatagagaaaagttcctcatagagcagctctgcccttatctgtagacttgtaatagagaaaaagcccagctcccatacagaaaccctccaagagtcctcaggacggaataattggttttctgataaaacccaacctctgacccctccacataaacaacaacaaataaggccatacatcactttttctgagtgcactattctgggttgagctaaaactgaatatttgggctcagcattactacttgtctccctagaatttggagagtgcagggatataagaggaaatgggcagctggggtaaggaaggggtgtgaagggccggccccagggtgttgcctcggctgcacagggaggtgagggccggcggctaaccttctggccccctcagggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactttaacgcctatggcatcggggccctggccaagtcatcattctcagggatctcacggagcatgaaggaccatgtgacaaagccaacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcacggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtctcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactcttagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagccgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttgggttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcaggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggaaaaaa

SEQ ID NO: 21 - DNA, 3363 bp, Homo sapiens
gcccccgcccggcccgccccgctctcctagtcccttgcaacctggcgctgccatccgggccactgtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgcgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggcgctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccttggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccagggtgactcttcgcctgcccagcctgagtggctcagatgggatcccgtatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaa

SEQ ID NO: 22 - DNA, 1017 bp, Homo sapiens
gaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggttgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaaaaaaaaaaaaaaaaaa

SEQ ID NO: 23 - DNA, 1393 bp, Homo sapiens
ggcacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccggaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagtattatttgcaaaagccaagaggtgtaaacaacccaagtgtccatggatggatgaatggacaaacaaaatgcgatacacacacacaatggaatgctattaagccttaacgggaaggaaatcctcttaaagatttaaactgatccttttaaggatcacatgctacaactagaatgaaccttgaagacgacactgctaagtgaaataaactagtcacaaaacgaaaaaaaaaaaaaaaa

SEQ ID NO: 24 - DNA, 2608 bp, Homo sapiens
agtgttactgcggtgaccgccagagcagcctcgacgctatggaggagcccggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagctcagccgtgccactgaacagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcacttgatgtttcaaatacagcatttggcagagagcatgccccgaatggtcccgcaccattgggtcagcgttcatctgaaacgagagcttttctctctcctcaaactttgttggaggatccactgggactctcacctgtgcttccggagggaggaggaagaggcccaagaggcccagggaatcccctggaccatcagattaccaatgaaagaggagaaccaagctgtgacaggttaaccgatcctcacagggctccttctgacactgggtccctgtcatctccggtggaacaggactgtaagatgatgtttcctccaccaggacaatcatatcctgattcagctcttcctcctcaaagggaagacagattttattctaattctgaaagactgtctggatcagcagaacccagaagttttaaaatgacttctttggataaaatggatgggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctacccaccgaggggtttacctccttactttcacccgagacctggattttaccccaaccccgcattctgaaggtagaagcgagttcccttcaggattgattccgcctttaatgctactgaacatccaggaccacaaaagaaacctgacaatattgttgctttcttcaaaagtaattttgactgatctcattttcagtttaagtaactgctattacttaagtgattgcacttttgctcaaattgaagtttaatggaattataattctcaggatagtattttgtaaataaagatgttttaaataggaa

SEQ ID NO: 25 - DNA, 972 bp, Homo sapiens
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 26 - DNA, 933 bp, Homo sapiens
atgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccttgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataa

SEQ ID NO: 27 - DNA, 381 bp, Homo sapiens similar
atggcaggtgagatcgccaaggctcaggtcgctcggcctggtggcaacactgtcttcgggaagatcatctgcaaggaaatcccagccaaaatcatttttgaggatgaccagtgccttgctttccatgacacttcccctcaagcaccaacacgttttctgttgatatcgaaaaaacatatatcccagatttctgcagcagaagataatgacgaaagtcttcttggacacttaatgattgttggcaagaaatgtgctgctgatttgggcctgaataagggttatcaaatggtggtgaataaaggttcagatggtggacagtctgtctgtcaagttcatctccatgttcttggaggttggcagatgcattggcctcctggttaa

SEQ ID NO: 28 - DNA, 4145 bp, Homo sapiens
gggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaaaaaaaaaaa

SEQ ID NO: 29 - DNA, 2605 bp, Homo sapiens
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagaatctttgcaatcagaaaacatatattttgaaagtgagaatcagaagcttcaacagaaacttaaaataatgactgaattctatcaagaagatgaaatgaaactctataggaaattaacagtggaggaaaattaccgaatagaggaagaagagaagctttctaaagtggaagaaaagctcagccgtgccactgaacagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcacttgatgtttcaaatacagcatttggcagagagcatgccccgaatggtcccgcaccattgggtcagcgttcatctgaaacgagagcttttctctctcctcaaactttgttggaggatccactgggactctcacctgtgcttccggagggaggaggaagaggcccaagaggcccagggaatcccctggaccatcagattaccaatgaaagaggagaaccaagctgtgacaggttaaccgatcctcacagggctccttctgacactgggtccctgtcatctccggtggaacaggactgtaagatgatgtttcctccaccaggacaatcatatcctgattcagctcttcctcctcaaagggaagacagattttattctaattctgaaagactgtctggatcagcagaacccagaagttttaaaatgacttctttggataaaatggatgggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctacccaccgaggggtttacctccttactttcacccgagacctggattttaccccaaccccgcattctgaaggtagaagcgagttcccttcaggattgattccgcctttaatgctactgaacatccaggaccacaaaagaaacctgacaatattgttgctttcttcaaaagtaattttgactgatctcattttcagtttaagtaactgctattacttaagtgattgcacttttgctcaaattgaagtttaatggaattataattctcaggatagtattttgtaaataaagatgttttaaatag

SEQ ID NO: 30 - DNA, 3093 bp, Homo sapiens
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagactggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggccccccggcgcgcctccaggccggcccgagtccttcgcctttgtggatgaggatgaggacgaagatctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggc

SEQ ID NO: 31 - DNA, 1130 bp, Homo sapiens
gcccgagattcgctgcccgccgtaccgaacccgcttcggctcctcggggcccggggctctccgggacctacacagcccgggagactccggcggggccgcctgccctcgcccgagcccgggcgcccaggccgcggcagcggctcccaacgcctctgcccgaggagagccgcggcctcgatgccccaacgccctccctgtccagttgcttgaaggcccctgcgaggggcgaggccggggaggcgctggagcgggtccgagtgggctttcgggaccgcgggtgaactggaatcccgaccgcgctgggggcagtggaggcccttccaccctcgccgcgccccgtggggaatagtcccccacctcccgccatggctgcagcaggaggagacgacgtcctccattttgtcggaacgactgtgggaacttgggaccccctaaaaaccaaaccccgtggggccgggaaacttgtcctcgggaagccccaactggactctgccattcggccaagggaacaaccccggctgctggcgtctgcgtccgcggggccacaggggacgggcacgacggtggagagacccagacgcagctccccgcctccatcaaccaagatggagggagctgcgggctcccctggagctgggctcccaccggttggaggggctgaggcctgccctggggcgtccttgggcgccgccgtcctgtgctccgcagcccggggcgctggccctgcccaggcctctctaccgcctgccaccgtctcctggtcctcaatggttgatggagactccatggaggctccctccacagcccgctgcatcgcggggcgcactcgctgcggccgccggggggagcggagtcagggacagacgacgacaggcgcccgaggagggcgggccccacaggccacctccacgaggggtcttctcttttgttcctcgtctacacctacgtcttcggcggacgtcatggtgctgaaccatttccaagactcacgtaaagatggaagcgatgtcgctttcgtctcgccctggcggttcttagtgggattacaactgaggatgttggttattttcccacccaaatggatgggcgacttctcaatttcacgattatctgacaccattgcctattaa

SEQ ID NO: 32 - DNA, 5977 bp, Homo sapiens
gtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacagcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaaaaaaaaaaaa

SEQ ID NO: 33 - DNA, 447 bp, Homo sapiens similar
atggggccaagtgcgtgctccggcacccgggcgcctgccatgggctttgtggggacgtgggcctgcatagcaccctgcggggcatctcatatgagcgtgctgctgcataaccgctcacagtgcgtccagaagctggggatgcgctgcggcctgcagggggcgcctccaccgcgtgcaggatggcctgctgcgaccagctccaggatcgcagtcacctgctggctcaccgcgatcctcgtcctggcgctgtgtgaggaggtcacggtctacaggatggtaagcgacagccgctgcagggagaggagccacccctcggtgccttactatgacttccagaagagctggcgtcatgaatgtcatctaccccaaatcacccaccgtttcatcaccaaggaggcatcttctcccactggaccaagaggaagcctgtcctggaggggcaagtag

SEQ ID NO: 34 - DNA, 5217 bp, Homo sapiens
agcgcgcggagggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatata

SEQ ID NO: 35 - protein, 323 aa, Homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 36 - protein, 226 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 37 - protein, 777 aa, Homo sapiens
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQESLQSENIYFESENQKLQQKLKIMTEFYQEDEMKLYRKLTVEENYRIEEEEKLSKVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 38 - protein, 146 aa, Homo sapiens
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 39 - protein, 357 aa, Homo sapiens
MALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENGDKRKCG

SEQ ID NO: 40 - protein, 126 aa, Homo sapiens
MAGEIAKAQVARPGGNTVFGKIICKEIPAKIIFEDDQCLAFHDTSPQAPTRFLLISKKHISQISAAEDNDESLLGHLMIVGKKCAADLGLNKGYQMVVNKGSDGGQSVCQVHLHVLGGWQMHWPPG

SEQ ID NO: 41 - protein, 1045 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 42 - protein, 148 aa, Homo sapiens [sequence omitted]

SEQ ID NO: 43 - protein, 96 aa, Homo sapiens
MAAAGGDDVLHFVGTTVGTWDPSKPNPVGPGLVPEAPTGLCHSDKGTAPAAGVCVRGAVLVGRDGGDTQTQLPASINQDGGSCRLPWSWALAGWRG

SEQ ID NO: 44 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 45 - protein, 777 aa, Homo sapiens
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 46 - protein, 254 aa, Homo sapiens
MAAAGGDDVLHFVGTTVGTWDPLKTKPRGAGKLVLGKPQLDSAIRPREQPRLLASASAGPQGTGTTVERPRRSSPPPSTKMEGAAGSPGAGLPPVGGAEACPGASLGAAVLCSAARGAGPAQASLPPATVSWSSMVDGDSMEAPSTARCIAGRTRCGRRGERSQGQTTTGARGGRAPQATSTRGLLFCSSSTPTSSADVMVLNHFQDSRKDGSDVAFVSPWRFLVGLQLRMLVIFPPKWMGDFSISRLSDTIAY

SEQ ID NO: 47 - protein, 177 aa, Homo sapiens
MGGEERGVLPPSTPQLTLCPEGVCEPEPPAFLGIRTSNAGQPLKASRNSHPQRPSQQIGCERDRSGPRGREWRWEGGAEAAAACGLETREDGRGRGLLVFYGPSTPTTTHSSWRPRATVGLLGILRLRLVETPGDGGALGHSETALGGAPYWPDWISQPATQPQATRKKPDLAFTAS

SEQ ID NO: 48 - protein, 337 aa, Homo sapiens
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSSNSTKKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWSGFSFDFIFTQKSGL

SEQ ID NO: 49 - protein, 551 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 50 - protein, 558 aa, Homo sapiens
MYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKNLTHSMEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 51 - protein, 845 aa, Homo sapiens
MATIAAAAFEALMDGVTCWDVPRGPIPSELLLIGEAAFPVMVNDKGQVLIAASSYGRGRLVVVSHEGYLSHAGLAPFLLNAVSWLCPCPGAPVGVHPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQVLSRNSGRRG

SEQ ID NO: 52 - protein, 988 aa, Homo sapiens
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDWIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGPPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 53 - protein, 213 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKVNAGMGNSGITTELTLKYIITNVTTLETGISSVNAGQDVNIIITYKTSL

SEQ ID NO: 54 - protein, 109 aa, Homo sapiens
MAAGVVFLALSAQLLQARLMKEESPVVSWRLEPEDGTALDVHFVSTLEPLSNAVKRNVPRCIIILVLQEPTPFRISVTSSCFVQNTLTKLLKDRRKMQTVQCATAQETS

SEQ ID NO: 55 - protein, 1377 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 56 - protein, 216 aa, Homo sapiens
MVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 57 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLASGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARALTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRVTLRLPSLSGSDGIPYRTVSEWLESIRMKRYILHFHSAGLDTMECVLELTAEDLTQMGITLPGHQKRILCSIQGFKD

SEQ ID NO: 58 - protein, 229 aa, Homo sapiens [sequence omitted]

SEQ ID NO: 59 - protein, 307 aa, Homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFLGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 60 - protein, 860 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 61 - protein, 322 aa, Homo sapiens
MAAPPSPGRTADQADQVCTFLFKKPGRKGAAGLRKRPACDPEHGESSSSGDEGDTVAQPPRVAPRPRGLHSWQKAAHGDRRGEEAAPESLDVVYRSTRSAKPVGPEDMGATADFEQDTEKEHHTPTILKCSQRVQEALRGREHDHIYRGIHSYLRYLKPKDTSMGNSSSGMARKGPIRAPGHLRATVRWDYQPDICKDYKETGFCGFGDSCKFLHDRSDYKLGWEIERELEEGRYCICEDENHEVGSEEEEIPFRCFICRQAFQNPVVTKCRHYFCESCALEHFRATPRCYICDQPTGGIFNPAKELMAKLQKLQAAEGKKR

SEQ ID NO: 62 - protein, 310 aa, Homo sapiens
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 63 - protein, 1115 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 64 - protein, 332 aa, Homo sapiens
MDSTSSLHGSSLHRPSTEQTRTDFSWDGINLSMEDTTSILPKLKRNFNAYGIGALAKSSFSGISRSMKDHVTKPTAMGQGRVAHMIEWQGWGKTPAVQPQHSHESVRRDTDAYSDLSDGEKEARFLAGVMEQFAISEATLTAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 65 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 66 - protein, 318 aa, Homo sapiens
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKMITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 67 - protein, 310 aa, Homo sapiens
MQLNNNVTEFILLGLTQDPFWKKIVFVIFLRLYLGTLLGNLLIIISVKTSQALKNPMFFFLFYLSLSDTCLSTSITPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCLATVFPMDKMIAVFYTVGTSFLNPVIYTLKNTEVKSAMRKLWSKKLITDDKR

SEQ ID NO: 68 - DNA, 2010 bp, Homo sapiens
caagaagtggcgaagttacctttgagggtatttgagtagcggcggtgtgtcaggggctaaagaggaggacgaagaaaagcagagcaagggaacccagggcaacaggagtagttcactccgcgagaggccgtccacgagacccccgcgcgcaggcatgagccccgccccccacgcatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggcgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagcgtaccttgaacagagggaggggaggacccatggctctccccccctagcccgggagaccaggggccttcctcttcctctgcttttatttaataaaaataaaaacagaaa

SEQ ID NO: 69 - DNA, 2740 bp, Homo sapiens
caggtgtccgttctccttggcagggccggccagaagcaataggtccgggagctccagggctggactggaggctgccacccccatggtgacctcgttggcaacttctcccaaccgagtcacctggggccagaggtcagaggtcggggcaggatagatgtcggggcagactgtacgaagttgctctcaaagatggggaagtcccgaaactggtcgaattcgccgctctggaggtagcgttggagccgtctgggacggcccgtgggagaggctgccatcccacctggttccacctcgccagctccacccagggccggcttagggccgcgatcccgcctcattgcaatgtccccgtccgacgggagcggacggaggagcagagggagaaagcgagggggcgggactacgcgcactgtgacgtcatgatgcggagcgggctttatgacgtcacacaagagcgggctcctgatttgtgatgacgtccctggagggggcggctcctggagatcaggccaaaggggcggccccatcctgctgacgtcaggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccagccctgagacggcggccttcattgagcgcctggagatggaacaggcccagaaggccaagaacccccaggagcagaagtccttcttcgccaaatactggcacatcatcctggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 70 - DNA, 4827 bp, Homo sapiens
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcaaaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcaggcaccaacgcccaggtcacctactcgctgctgccgccccaggacccgcacctgcccctcgcctccctggtctccatcaacgcagacaacggccacctgttcgccctcaggtcgctggactacgaggccctgcgggagttcgagttccgcgtgagcgccacagaccgcggctccccggctttgagcagcgaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgagattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtcagaaaaaaaaaaa

SEQ ID NO: 71 - DNA, 3187 bp, Homo sapiens
gctaggcctccacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcccggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtggggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtggggggtcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcaccaaaaaaaaaaaaaaaaaaaaaaaaaaaaaaaaaaaaaaaa

SEQ ID NO: 72 - DNA, 5186 bp, Homo sapiens
gcttctgctgggcagggccggctgttaatctcgcctggcggagcggacaccggggcgtggtgggggagatgggccttataggtggcgtccgctggtgagaaacaccttgcgcaggtaaaagggtggcggcgagagggagttcccacccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcaaaaaaaaaaaaaaaaa

SEQ ID NO: 73 - DNA, 430 bp, Homo sapiens
ttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagat

SEQ ID NO: 74 - DNA, 3302 bp, Homo sapiens
cggtgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctctcacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagg

SEQ ID NO: 75 - DNA, 6753 bp, Homo sapiens
gcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccagcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaaggaggtggatgagtgttcctggccagatcacggcgggtgcgagcatcgctgtgtgaacacgctgggcagctacaagtgtgcctgtgaccctggctacgagctggccgccgataagaagatgtgtgaagtggcctgtggcggtttcattaccaagctgaatggaaccatcaccagccctgggtggccgaaggagtatcccacaaacaaaaactgtgtctggcaggtggtggcccccgctcagtaccggatctcccttcagtttgaagtgtttgaactggaaggcaatgacgtctgtaagtacgactttgtagaggtgcgcagcggcctgtcccccgacgccaagctgcacggcaggttctgcggctctgagacgccggaggtcatcacctcgcagagcaacaacatgcgcgtggagttcaagtccgacaacaccgtctccaagcgcggcttcagggcccacttcttctcagataaggacgagtgtgccaaggacaacggcgggtgtcagcatgagtgcgtcaacaccttcgggagctacctgtgcaggtgcagaaacggctactggctccacgagaatgggcatgactgcaaagaggctggctgtgcacacaagatcagcagtgtggaggggaccctggcgagccccaactggcctgacaaataccccagccggagggagtgtacctggaacatctcttcgactgcaggccacagagtgaaactcacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaagaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatatttttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaatcctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaacggatggtttcattaaagaatgtggattt

SEQ ID NO: 76 - DNA, 1085 bp, Homo sapiens
atgcaccccacggccccggtgcccgaacccagctccagcaccaaccgccggctcagcgtgtgggcccagtcgccagaaaactcaggcgtttccaggctgggcagtgcagcgagctctggagagtgcgccctgacccggggtccaggcccggtcagtgtgaccttgcgcgagtcacggtcgtcctccgcccgccaggccccggacggcgtctgcagggtccgattcctggggatttcccgacgccccttcccccgaggttcaggggctgcctggggtgccggggaggggggccgagggatgggggacctggggctagaaggccaggcgccaccacctgccgcccaggcagccaggcgactcttctttcgcgggtcacgcggcctgactcaggcccctgctcctgtggccccgaaactcgccgttcgctgggccttgcgttgcactcggcgtgcagttccccctcggctcgcggccacttggtccgcgccgcctgcgtcctgtgtgccgagcccgcccgcactgcggggacaggccgggcgccgcccacgccgcgctctgccgggcgcacagtctgcctgggaagcgcgcggccgggcgggcggccatggcgcggcacgctgggaggtagcgcggcggctgcaggagcgcacagtcggccatggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctaccccc

SEQ ID NO: 77 - DNA, 1828 bp, Homo sapiens
acttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaataaaaaaaaaaaaaa

SEQ ID NO: 78 - DNA, 2034 bp, Homo sapiens
atcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaaaaaaaaaaaaaaaaaaaaaa

SEQ ID NO: 79 - DNA, 1346 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttgaatgaaaatatttgcaaaaaagtccaagctggaagcacctgcagaattaatcacatgctcttatttcgttgat

SEQ ID NO: 80 - DNA, 1631 bp, Homo sapiens
agcttgggggtcccgggaaggagctgggaggacctaggcggccgttccgcggagcccggccgaggaggtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatc

SEQ ID NO: 81 - DNA, 2355 bp, Homo sapiens
gggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcgaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtgtcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctg

SEQ ID NO: 82 - DNA, 775 bp, Homo sapiens
ctcaacattgtgggtttgcaattcagccatcatcatctcttcaatcaagagcaagtattatgcgcaaggcttctccaactttatgaatgttttcaggacaggcagcaacagaatgtatctcagctgctttatgagaagctttaaaaaattgtacaagtaataccggaatacgttctccctggaaaagattaattgtagaagtgtcaagatgtgaaagccctacttcgttcatcacctcatgctgaaagcactgacagatgctaccaaattgtcaaatgaaaattcagaaattaaccagctgaccagaaaatctttacaagattattattggcaaataagtaatacaaaacagatgtatgacttagaaaggggaaaggacctctccctactacacagtatattacgaacttggaaacagattaaatctcttcgacatgggcaagggtttacaagcaccccaataaagttacaggttcagaggattaaaatgaataaatgtgatgaacaagagcaaatctcagaaatgtctgaaactgagaagaaaaatgaaggaaaagaacttaagaatgggaaaaaactggaggacacccatataaaaagactatctaaacaaggggaagaatacaggagccataaaatgaaagttggagggagagagaagaaagaggaggaagaagatatttgtgctggaaaacctagactaaaacttagtggaagtcaaggcaaaaggatgtatggtgttttatatctttgcaaagccattgccatccgatag

SEQ ID NO: 83 - DNA, 684 bp, Homo sapiens
caggtccctccgcagcgggttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttgtaccggctccagttcaatgagacctttgcggagatgaaccgtcgctccaatgagtggaagacagtgatgggttgtgtcttcttcttcattggattcgcagctctggtgatttggtggcagcgggtctacgtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctcc

SEQ ID NO: 84 - DNA, 3457 bp, Homo sapiens
gaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgagggaagtcccacctggccatcgtgcagaaggtgaacaacgagggtgaaggcgaccccttctacgaggtcctgggcctggtcaccctggaggacgtgatcgaggagatcatcaggtccgagatcctggacgagtctgaagactaccgagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaaaaaaaaaaaaaaaaaaaaaaaaaaaaaa

SEQ ID NO: 85 - DNA, 2507 bp, Homo sapiens
tggagcagctaatcctcacagacctgtaggagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctctaaaaaaaaaaaaaaaaaaaaaaaaaaaaaaaaaaaaaa

SEQ ID NO: 86 - DNA, 4889 bp, Homo sapiens
aggtatttactttttgttgaattttaagggacctcaagtgaaataataatcggtgaattcaggatcaacctttatgtccagagcgtttgttccgtcgtccatttcttgtctagagtagtggtatgagctgaaaacattgctaagtgatcaccacatattgttgatgtaagggctactggttattacaagagatttttatgactcctgctgtgggggtgccctttctacccggctgagcttggtgggagccaaggctgagtcggatgtatctttatattcccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggatcacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgctctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctctgagactttgcatggatccgcggtggggagctgcccccacacaaacgtccggctcttctcaggccaggtggctgccctgacatggcatgatgtccagcgcatggacgtcacccttgcactggagcccagccaaccgctgcatgacagccctcttcccccttgaaccccaagtctgcacacaccagtgcctcctcttcctggatcctcctgatggcctgtacacagaactggggtgtgggtggtgggtttttaaatgaaaaccagtccacacatgcttgagggctggagccgcctgccgtcagggcagtgccatgctgacctgctgaccgttccattttgtcaaggctcatgagcaattttaaatgtttactcgtgggtgaaggtttttgtttcagctgtaccccctatagcagggccatggggagcctaagaggttctccttggcacctgtgcgcgctctgctgttgccggtgagtctgaaattccagggaatgccgtgaggggccctctggcgtttgttcttggacaaatgtgctttcacccccattaagccctgcttgttggtcttcatttcatttgtgctgcgctgcccctcctgagggacagacgctcaggcagtgcttccttccagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttatttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggaaaaaaaaaaaaaaaaaaaac

SEQ ID NO: 87 - DNA, 2121 bp, Homo sapiens
gatcgggtaggcggctctttgtcgaagctagaggaccggcaggcggcagcagcaactacggcggcggcggcagaacccagcagcgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccgccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaac

SEQ ID NO: 88 - DNA, 4049 bp, Homo sapiens
cctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaac

SEQ ID NO: 89 - DNA, 3659 bp, Homo sapiens
aagctgggtatggagcccctcagcggcggcggggtctgtgagttggacgcggggtcttggcggggaatggaggtagaataaacgtgggacccggagtgcaccaagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcagcaa

SEQ ID NO: 90 - DNA, 1944 bp, Homo sapiens
caccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaaaaaaaaaaaaaaaaaaaaaaaaaaaaaaaaa

SEQ ID NO: 91 - DNA, 1516 bp, Homo sapiens
  modified_base (13): a, c, g, t, unknown, or other
  modified_base (1447): a, c, g, t, unknown, or other
ggcacgagcccgnttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacccgccaggacagtgagctgctctgcaatgactgctactgcagtgcgttttcctcgcagtgctccgcttgtggggagactgtcatgcctgggtcccggaagctggaatatggaggccaaacatggcatgagcactgcttcctgtgcattggctgtgaacagccactgggctcccgtccttttgtgcccgacaagggtgctcactactgcgtgccctgctatgaaaacaattttgctcctcgctgcgcccgctgcaccaaaacgcttacacagggtggattgacataccgtgatctgccgtggcatccaaaatgtctggtctgtaccggatgccagacgcccttggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttcacctgcgaccgctgctctaactccctggtgggccagggcttcgtaccggatggagaccaagtgctctgccagggctgtagccaggcagggccctaagccagggctcctggaccaaggctttcctataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcatccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgnccatagatgggcagaggggtgagattggctcatcccccttccagattctgcaataaagcggtgtgagga

SEQ ID NO: 92 - DNA, 2020 bp, Homo sapiens
aggctggcgcggcttgagccgccgccggactgacagctcggtctgcggaccatggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgagggccgctgcagctgcagcgcgggattccaggagcgtggtgacttctgcgaaggtatccagttggctgggggccgtggggtgggagtgtagagcgtaggtggcaattgagagagagtgtgccctagaggaaagaggcgggtgtggggtcggggggcggtggagaaaccttggactctggagcccaaggagagccctgaagtcttgtggagtttccagtgagtccagtcagggccaatgagtgaacttactagatgaaattgactggctaaggaggcattagggatctatatcttaggcaccttgcacaggccttctcgtttatttattttcatggcaataaaggaagtcattgttttttttttttttttaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagacggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtaccccacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctgggttctcaggctagtgggggcattaggaacagacctctcattctctctcttgcctgtggctttggatacagagggtgatgatggggttattaatgtgtgtacttaatatagaaagatcaaggt

SEQ ID NO: 93 - DNA, 3176 bp, Homo sapiens
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgc

SEQ ID NO: 94 - DNA, 478 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaa

SEQ ID NO: 95 - DNA, 1669 bp, Homo sapiens
gtcctcccgggctggcagcagggccccagcgcaccatgtctgccctcggagtgaccgtggccctgctggtgtgggcggccttcctcctgctggtgtccatgtggaggcaggtgcacagcagctggaatctgcccccaggtcctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattatttt

SEQ ID NO: 96 - DNA, 852 bp, Homo sapiens
ggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcacgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttaccccaaaaaaaaaaaaaaaa

SEQ ID NO: 97 - DNA, 2087 bp, Homo sapiens
ctcccaggtgcctggcagagagtcctcaccagccccctgccggatgtctggctggcatctgaggggactgaacatggcaagaagcaaaacagcagcacaagaaaccagtttcttcatctgaaaccgagcaggctctactccagaacagaacccacagtcccaggcgctgggccttcttcttaagttgggaaatcactcatccccaggagaaaaaaagagcaaaagcttccagtactggggatgtggggagaggttttttaaaaatatcagcccaatatatgggaaaatatgggatgcaggcatccccaggtgtcaagcgtccagatccgtagacacactgggacgatggtgatcagtatcactccctctgactcatcggccctacagagaagacaccatgctggtgcacagtcggtgccaaacccgcgtttgtaaatgaataagtgttgctgccctggtggaagcccagctcatgtggaggaagccagcttgcagagagagcaagaacagagccagcacacacattggagcaaaggcaagggcagatggaaagttctggcggcatcatgccaaggctcccatccgaggcctccctgaaccccactctctcggcgccaccttggatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccaaaaaaaaaaaaaaaaaaaaaaaaaaa

SEQ ID NO: 98 - DNA, 2793 bp, Homo sapiens
atggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagcataaaataaaaataaaaagcgttgctgaaaaaaaaaaaa

SEQ ID NO: 99 - DNA, 5249 bp, Homo sapiens
aggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaac

SEQ ID NO: 100 - DNA, 3555 bp, Homo sapiens
ccagcctcagcctcatgtaacccattgtttccaaagggctgcaggctgcagaagcccccaagctctcaggccagctgtggcttctttgctgagatggaggtatagccaagaaagcagcctgaaaagtaagaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcggttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcctcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccattttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 101 - DNA, 4271 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagaatccattagaggacacactctgattaaaaattaaacagtaaaagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctaaggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 102 - DNA, 4190 bp, Homo sapiens
caacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaaaaaaaaaaaaaa

SEQ ID NO: 103 - DNA, 2584 bp, Homo sapiens
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacggccgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcagccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttccgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 104 - DNA, 3970 bp, Homo sapiens
gggcggagccaaagaatgctccgcctgcgcgcgccgcttccgttgccatagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtatccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaaaaaaaa

SEQ ID NO: 105 - DNA, 3231 bp, Homo sapiens
atgggcttcggtaagacccagtcaggccctgaaggactcaaggctgaggtgctggactcagggcatgaaagctgcttcccaaaggggcctggacaccaggcaccaaaaatgcagatgccaacccagcggaggatgcaggggcaggatcctggagcttctcacaggcctggtctgtgtttcccctgggcctctgcagcaggggtcgctggacaggaggagcagctgagaaattaccagaagcaatggaagacgagggtgacagccgtcaacagccgagaagaagtagtagatgcaggaacccatggccgtcacacgggaagaagccaccagcagcttctccagctgcacccgctgacccccagagctcgctcgcaggcacagcccgagggagaacctgtctctgcggagaaagacactctgatggcagccgactggattccaccagaacccgagggcaagcattccttgggaagagccgatgctcgtgccctggagaactccctgttcagggatgacaatgggttccctggtgatttggaggcctggggcctgggtgggagctgctccctctacccctggagacactgcccaggaatccaacgtgctggcactggcatccagggagctgtgaagggcacgctgtgttgcaagctgattgggaaacaggttggaggggtgggggccgaggcgctcagcagtattcaggcatctctcagctggcgacaggagctgtcccaggccctgcaggctcagctgggtgtgctgccgctgggctcttcagaacctttacgcccaagtcctgtccagggggagcaccctccacctcgggccggctgccatcacagccttcaatcctgcccagagtccctggagactgttgtcattaaaccccactcctgtttaggaaaccccagggccagaccccactgccggaacaggaccctctcgacgctgactgagggagcggaggggatcgggaccagggggaagcagccccccagtaaatccgaagcacaggcacggcacagccccaagggagaccttgtaggcgcctggccagcagggctgaggagaaagtctccactgcagggcgcctcctgggcccacgccgtgtggtcctggccccaagctgcccactgggcattcagcctggacagctctcggcgctggagacccagaggacaaggggacagcaacatcaaagaccacagcgacccgaagccccagaagcaaaagccactctcacagcggaaggagtggacagagcccctgtggagctcacccagccctcctgtcccaccaaggggccttctaggacctggagccctgccctcctgccgaggagcccaggccgcctgtcaggcagtcagagctcccaatcagaacaaagccggcagttttgagtctgtgcacatccccctgcagcacaggaggcaggatgatcagccgctccagcccagcatccccacggcacactcgggagcacaccccacccagaggccagacagaagaagagagatggctgcggaggagcttctcgggtcaacagggtgcacccagcccctggtgccctctgcctctgggaaccacatcttggcccccatctgcagatatggtggtctcagggacagcgggcatccccgtgggagtgtgggcggcgctgagcacgagcacctggggctcctcgacgcagtgtggacggaccactcgcgcacaagaggcggcccagaacggctggcactagaactgcaggtggactgtgccaggtgccaggtggggccctcccagcaggcggcctggggacacgtgggcactgacgaaggtggcaggaacaagcctggtgggagcagccccccaacccccatcaaaacaatagcccccaacccccatcaaaacagcagcccccaaaccccatcaaaacagcagcccccaacccccatcaaaacagcagcccccaaatacccatcaaaacagcagccccccaaaccccatcaaaacaatagcccccaacccccatcaaaacagcagcccccaacccccatcaaaacagcagcccccaaatacccatcaaaacagcccccaaccctcatcaaaacagcagccctcaacccccatcaaaacagcagccctcaacccccatcaaaacagcagccccctaaacccccatcaaaacagcagccccccaaacccccatcaagacaacagcccccccaacccgtatcaaaacagcagcccccaacccctcatcaaaacagcagcccccagaccccatcaaaacagcagccccccaacccctatcaaaacagcagcctcccaacccctatcaaaacagggtgcgggaaggtgtcccggcagcgcctctccatcgccacaggcccgcggacagtagccaagacccggggcagctggaggctctgcggggggcggtctgacagccccacctgccaggacgcggtggtgcctgggaatagggaaacggttcgagtcccgagctggggagggtctggagggaagggctgcaggggcgtccgtggccgcgaagaaaggccaaagcgccaggcacagggcccggagacggtgacagacctgtccctggcgcggccgacgtctccgcccccgggtgccccccgcgccgcgcccgcgggaccgagccccgcgcccgcttaccttggagacgcagcgactgcagcggagcaccgcccagccccgcccagcccggtcccgggcccgcccccggcccccagcgtccggcgcccgcccagcgtcccgccccgcgcgctcattgcgcagggcgcggccgacccgcgggtcgtgggaaccgctgggcagggggcggcggggcccctcacctggctctggggccccccggggacgaccggaccccgatctctccgccccgcaggacgcgcgttgacggtgcggcgggggatggatgagcgcggccgcggcctcctggggtggggtgggttggcggcggggcctcgaggacggtgcggggcgagccccgaccgcgcccagttctttaaggagccgcagacgtgctgcccagagatgggcttctgtctagttctcctgagaaattccacactcgcagctgggaagtcgggggacccccgaagctgtgcggcggccacgctgcggctcctgcttccctcctgctcgggtgcgggctcggctgccttctcgtcccgcggagcccggagtgcctccccctcgggtagatcctactaa

SEQ ID NO: 106 - DNA, 2416 bp, Homo sapiens
gggggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcgggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacggaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcgctggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacaccatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatccctctttgagtgctgaaagtgtaaggaagctttcttcttacaccttgggcttggatattgcccagagaagaaatttggcttttttttcttaatggacaagggacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaaa

SEQ ID NO: 107 - DNA, 849 bp, Homo sapiens
ggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaaaaaaaa

SEQ ID NO: 108 - DNA, 4613 bp, Homo sapiens
ttttttttttaatttctcccctcgggtcatttttaacaataacaaaaaatattttcagctgaaacttcagaccggagacctgcaagtaaatgagacattggaccgggaagaattgtgtagaatcactgagccttgtgtgctgcaattccaagtgttactggaagaacctttggaggtttaaacttttggtcagtgacataaacacaattcccctgtattcccagaagcagaaattattttgaaatcatggaaaatactcctccaggaactgtgtttcctctgaaaaatacacaagatttggatgtggccatcaataacatccaaaactacaccatctacccctactcccatgtccacgctctcacccaaaatggcagtgaaggcagaaaatacccagagctggttctggacaaagccctggatcgggaggagcaggctgagatcaggttaactctcatggcagtagatggcgggactcctcccagaactgggactgctctggtcctcattgaaatcttggacatcaatgacaatgcacctgagtttgtgtagccactctatcaggtgcagatatcagaaaacagccccctggattcccttgttgccactgtttccgctagagattcagacatgggaattaatggtgagatattctactcattttttatggtgatgaagagatttctaagacatttgcacttaatgaacgaaggggagaaattaaaataatcagaaaactagattttgaaaaaattgtgtcatatcaggtggatattaaagcctctgatggggcaggtctttctggaaaatgcactgtcataatacaggtggtagatatcaacgataacgctccggaactgaccatggcttcattcacaagccccatccgcgaaaattctcctgagaccgttgcagctcttttcagcattcaagaccgcgattctgggaaaaatggaagaatagtttgatcaattcaaaatgatgttccgttcatgccgaaaccttccgttgagaatttatactggctgttaacagaaggaccactggacaaagagattagagccgagtacaacatcaccaacacagccacggacttggggactcctaggctgaaaaccgagtgcaacataacggtgctggtctcctacgtcaatgacaaagcccccaccttcacctaaacctcctacaccctgttcgtccgcgagaacaacagccccgccctgcatattggcagcgtcagcaccgcagagactcgggcaccaacatccaggtcacctactcgctgctgccgccccggaacccgcacctgcccctcgcctccctggtctccatcaacacagacaacggccacctgttcgccctcaggtcgctggactacgaggccctgcaggagttcgagttccgcgtgggcgcttcagaccgcggctccacggcgctgagcagcgaggcgctggtgcgcgtgctggtgctggacgccaacgacagctcactcttcgtgctgttcccgctgcagaacggctccgcgccctgcaccgagctgatgccccgggcgggccgccgagccgggctacctggtgaccaaggtggtggcggtggacggtgactcgggccagaacgcctggctgtcgtagcagttgctcaaggccacggagccagggctgttcggcgtgtgggcgcacaatgcactgacaggctgctgagcgagcgtgacacagccaagcacaggctgatggtcctggtcaaggacaatggcgagcctccgcgctcggccaccgccacgctgcacgtgctcctggtggatggcttctccctgccctacttgccgttccctgaagcggccccggcccaggcccaggccgacttgctcaccgtctacctggtggtggcgttggccttggtgtcgtcgttcttcctcttctcggtgctcctgttcgtggcggtgcggctgtgcaggaggagcagggaggcctcattgggtcgctgctcggtgcccgaggacccctttccaggcatctggtggacgtgagcgacaccaggaccctatcccagaggtacaagtatgaagtgtttctgacgcgaggctccgggacaaatgaattcaaattcctgaagtctgttatccctaagcatccgggcgctgtgaatgatgggaggaaaagtccaactttgtaaatggttttggattcaattaagaatctgtagatttttcagagcatttaggataaaggttagtcctttatcaatatattaagtctctgttatgttttttgtgctatatggattttctaagatttttgctgatttcattttcctacttaagattagacattttctttgattatttgttcatacttggtctccttttatcatgtccattttgatgaatacaactttcaggtttactcattaatgaaaagtaatatttgttcaatttatcaacttttcaaaatcacaggctgttgacttgaagactccagctccattccgtttcattaaagaaagcttttctaaacttttgatgcttagaagacaggaacgatgatatagtgattattagtacatattctattgattctgtcttatgcttacctgtcttgaatttttaaatggagaagcgtctgcaaaaattgcatcgttttatttcacaatagcttgaagtgggaaagactacatttttccccaaacttaaagacttttctgctctttttataaccttcactccataacatatatgagcattattattactattattgagtcagagtttcactcttgtcgcccaggctggagtgcagtggcgcgatctgggctcactgcagcctcgcctccccggttcgggcgattctcctgcctcagcctcccgagtagctgggattacaggctccttgttttagtagagatggggtttcaccatgttggccaaactcaaactgacctcgggtgatacactcgcttctgcctcccaaagtgtggcattacaggtgtgagccaccttgcccggccatacgagcatctttagtgattattagattatctcaagattttaaaatcatagctcccttttgtagcgtctatctagcccacctgatctttttctggaaaattctccctgtctttggctgaagtgtaatgttgcagccacatttattttatatgacccacctccctctgtgatttcaaacacaaaaataagatgatcctagctggcctaatctgattctctctgtttaaaaaaaaatggctttaagaaccagatacaacatagtctctttgttaggaacataagcagaaagtggtgtcatatttggctaaacacttgcaaagaaatacagaacatcaatctattgagagacaagaaaaaataaggtaccaaaagaatgaccttgtcatagattttcctgttttagattttccagtccctcccaagtctttttcccttaggttgctggagacaaatttgtgctctttaataaatttccctctaattaaaaaatctaagtgaggtttttgttgtcaaaagcatgtttagatattcctgcattgttggtaagttagacctttcttcctattgggtttttattgtggcttttcatattagtatgacaacatttgggatcaaggaggttgtaaaatattagtagtctataagggacatgcactagcttttgtcagaatatacaattttgagaaaaactgaaggatctttccaatggtacagtctttgaagtgtttaatagaaattcttagaacattttattatataagagttttgaatatcgtaagtgtcataataacattactgtaaaaaaaaaaccttgacaatgaaaaatgtgtgtctaaaagagacataatccttatctttagggtcatcataatcttgttatgttctttctttctgtcatataatatatcccttgcttatgggtaggtaagttgttttgccacttaatgaaatgacattttaggtcattctgagttatttcacattactatttaaagggcataagaaaaaaccaacctaagaaaaaggtggccttggttaaccaacctaaaaaaagaaactgaaacccaaaaaaaaaaggaaattccaaaagaagaagaaaaaccaaccggcaaaaaggttaaaataaatgggaattaataaatggatccatttaacaaatatttattgagcacgtaccatgtgccagggattattttagatattggggatgcagcagtgaacaaaatgaagttctaacatgtgaggttgaaacagaaaggaaacaactaaataagtacatctatactacgtcagataataaatacgagagagacaaggcagggctgggtacagcagctcatgcctataaccccagcactttgggaggctgaggcaggaggattgcttgagctcggaaatttgagaccagcccgggcaacatagcaagacctcatctttacaaataattaaaacattagccaggcatggtgatgcgcaactgtggtcccagctacagttgctgaggtggggggattgcttgagcctgggtagtcaaggctgcagtgagcagtgattgtgccactgcactccctcctggacaacagagcaagaccccatctcaaaaaaaaaa

SEQ ID NO: 109 - DNA, 5431 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaa

SEQ ID NO: 110 - DNA, 2472 bp, Homo sapiens
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaaaaaa

SEQ ID NO: 111 - DNA, 4086 bp, Homo sapiens
atggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgttctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatag

SEQ ID NO: 112 - DNA, 2336 bp, Homo sapiens
ttgaattcgcccctgccaaaaaggtcgtgtgtctcctttgtgtgaggcacagcctgaggtttggggccaggcagatgtgggtttaatttcaggccccacaatgtacgaatttgggaaataatcctcttcaccttctctttcttttaaaacttaattacttaaactaaaaatagggccccatgtttcaaaattaaagaagcaaaagggtatagaaggcaaaatgttttcccaaaaccctgtcccaaacctctcgctggtcacccatctggctccactgcagtccattagatccagaagttgccgccttcacttcccttccttccccctcacccgctactccctctgctcgctaggctcctgccagccatgttcccacctcatgatgggtctttgcactgactacctcccaaccccacccaaattgctgcagggcctgccccccaccacttgatttggggccctcaggtcccttcccatatctcaggagcacttcccactcctttgctctttagcctcccttggcctacttcatttctcttgaacacggttaccgcagccccattcggtatcttattgtgtctgttcccagtcttgcccacccagaacgtgagccccgtgagggccccacagagcacctgcttgcaggaggtactcaatagatctgtgttgcgtgaaagcagcagagacacaaggctggcaaccgccccaactctgcctgccctgtcaactcaacctcctttcctccgtgcagtgggaagcctagagccccgagttgaggtcctgattaaccggattaatgaggtccagcaaggtgagttcaggggccttggctgccagctaggaccagctgcatggtttgcggggctcagtgccaagtgagaatgcagggtcccttgttccaaagttactggttattcacaacagcaacagcagagccttaaattaagtacagggcatttcagcatgcgactgccatagttacatgcccatgatcctggccctgctatcagcagagcctggcaaggagagctggaagcctcgtttcctactctataaaatctaggccactatagatttacctgaaggcaaatgagaaatgtcactgttgggaagagaatagaggctgcactcacacaatgtttttctgctctttggtgaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttaaaaaaaaaaaaaaaaaaaaaaaaaaa

SEQ ID NO: 113 - DNA, 2912 bp, Homo sapiens
ataaaccctgagatatgagggttgggcgagacatccgagcctgtttcgttccgtgttgggaccaggaataaccctgacttctgagctttcataaccccagggtcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactgatgaacaaaacagaacttctttttgacaccatagattcttctgaggccaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagccaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgtcatcgtgtgttacatttggacctattttaataaagggcctgtctcaaaaaaaaaaaaaaaaa

SEQ ID NO: 114 - DNA, 2376 bp, Homo sapiens
gagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaggatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagggtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtgatgcagcatgaatcattctgaatgctttgtctttgaagtgctcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaa

SEQ ID NO: 115 - DNA, 642 bp, Homo sapiens
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgaggtgggctga

SEQ ID NO: 116 - DNA, 2341 bp, Homo sapiens
agtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaagcattccttttgctctctttaagacctcacagattctgaccttagattctgtgacaaactgatacaggagctgggctggctatggctttaccacaacaagtaggtttgcttaagaaattactaaacaatggctgggcgtggtggctcactcctgtaatcccagcactttgggaggccgagatgggcggatcacgaggtcaggagatcgagaccatcctggctaacagggtgaaaccacgtctctactaaaaatacaaaaaaattagccaggcgtagtggtgggcgcctgtagtcccagctacttgggaggctgaggcaggagaatggcgtgaacccgggaggcggagcttgcagtgagccgagatcacgccactgcactccagcctgggcgacagagcgagactccgtctc

SEQ ID NO: 117 - DNA, 3685 bp, Homo sapiens
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctcaaaaaaaaaaaaaaaaaaaaaaa

SEQ ID NO: 118 - DNA, 2466 bp, Homo sapiens
ctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgtgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaaaaaaa

SEQ ID NO: 119 - DNA, 822 bp, Homo sapiens
aaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctc

SEQ ID NO: 120 - DNA, 5870 bp, Homo sapiens
gatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacagtacccagagggtgaaggacagaaggatgtgctcccagctcacctccgggtctgcatgtggcttggcaatgtcacagacagcaaggacctgcagctgctccgccagggtgacacagcggtgtacgccgagatggtgagtgtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgaggtgctggcgatgtgggatggggacggtgggcaggacaggcgggggtggtctggagtgcgctgcagccttctgctggtcctccctgactactggatccaaagctcacaccccgaaaaagactacctgggaggtggagggagacaggagagaaacgaagaggttctggtgtaacactggaaatcattttaccacaaacctctgcagtgaggagtaggcaaagggctgtagcatgcatgatcacttgtgggactcacgctgcccctgcgcagtagcaactactttgcagagaaggaaatagaggctccaagagataacacattccacgcacagtgatgcagggactaactgacagggccatttaggcccagccctgtctgactgcagatgccaggatgttgctcacctctcttctgagagtagcatgagggtcctcattcagaagctgtgtgccctgccgcaaatgtggcaaagagcacaagacggtcaggcctctgggactgaaggcttccccaagatcaggcaacttggctggttcccgctttaggccccgaggaggcccaaagtcagggtgcagctatttcctggcaggatgccaggtcactgaatggccatggggtcctcaatgagctagacggcacaggggccctgagaaatccaggcacttcctgcttcttcaggcctcagaggcagtcggcttcaggaactcctacctgagaactgatgaggccagacaaggcagcgggtgaggaggggcaatgcctgcgggctatggaggtcagtggaggatgcagccagtggccagaggtcacctccctcatgggttgggggacagcgtcccagccccgagggcaagcactgatccctcacaggacggggaagcctgtccttgtgcgccttcagacactggctcctctgcagccccattccctggccctgcaggctcctgctgcaccgctattgcccctcagcccccttctctggccaggaccccattacagaggcgctgcctgccccttgtcctgccctccttctttgttctggtagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacaga

SEQ ID NO: 121 - DNA, 879 bp, Homo sapiens
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagaaggaagggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaactttttataccaaaaaaaaaaaaaaaa

SEQ ID NO: 122 - DNA, 1218 bp, Homo sapiens
atggcggccggcactgaggagggccacggccgggccgggccgggcgtgctgcgggaagaggaaggctcgggaggtgggatgggaaggggaggccgagggacgggggtcgccgcgccgccgctgctgccagagaggagcctgcggctggcagcccggcctggcccctcattggccgcgggccgcggcgcctgccgggaaatgcagtccctggttcgggacgctggggctccggaggaagcggcgagtcggcggggcggagggggcgggagcgcgaaccaggaacgcccgcggcagctagcgtctggacgactagggagaccgggcgagagggccgaggaacgagggacggggagggactggttagaagcgaccctcgcacggtccccggtgggtcaccgcgcgagggcggggcagtccaggcgacccctcggccgtctcccgtcctacggctgtcagggaagggctccggttccggtagggtctgcatttggaaagccgggggcgatgcaagaccgccttggcgtcgtctccctctcagccccggctgagctgtcggatggtccccctcccccggttgcaagcagtaggagacccggccggcggcgccggctcgccgagggagcgcctcgacctccccggcaggcgccggccccgcgcgcctcttcctgctctgctgcggcccggaggcttgtgggtaaccgggaggacgacgtcagcgcccgccgcatccccgggtgccccccagccgcgggggaccgcgacggctccgtgaccgtcacgtgccggaggccgcggctgctcgcggccagaccttcgcatcgagggacgtgagggacatttgtcctagagggcccaagataagaacgagaggaagaaccgggaggcaactctccgtcatcctctagccccccgcatcctaggaaacgtatggaaaacaatggaaggttaagtgtgtgcacagtgatctggccctgcaggagtgtgccgaccaggtgatatttcctggggcctggtgataaggatttggaaggttacagcacagagacgtgaacgtaaaaaggaaacagaggcagcaagcaaatgaggaaaccgatactctgttctgagaataaagccattttaccgctagacgtcatactctgtagacgttatagtgctggatgtctttggtactattacaagaaattagatatctctatctttaaatatcacttaagg

SEQ ID NO: 123 - DNA, 3336 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgc

SEQ ID NO: 124 - DNA, 3271 bp, Homo sapiens
atggagaaccaagggacacgcactcagcagataaggcaagtcctgcttctctttgttttgctcggaatgtctcaggcgggctctgaaacctggagcttttctgtggcagaagaaatgcagagcgggagttttgtaggcaatctggcaaaggacctggggctgaaggtgagagaactgtcctcacggggggctcgggtggtctctaatgataagaaacagcgtttgcagctggacataaacactggggatttgctcttaagtgaaacactagacagggaggagctctgcggttccatcgagccttgcgtgctacatttgcaggtgttaatgcaaaaccccacgcagtttttacaaattgagcttcaggtcagggatataaatgatcactctcccatcttctcggaaaaacaaatgctcctagaaatcccagagaacagtcccgttggtgctgtgttcttactagaaagtgcgaaggatttagatgtaggaatcaatgctgtaaaaagctacacaataagccccaactctcattttcacattaaaatgagagtcattccagacaataggaaataccccgagttagttctggacaaggcgctggattatgaagagctcccggagctcagtttcatcctctctgctctggatggtgggtcccctcccaggtctggaactgccttggtcagggtggtggttgtggacattaatgacaactcccctgaatttgagcaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtatttttaattttttcttttctcccccaattttttttttttttttgagaccgagtctcattctgtcgccctggctggagtgcaatggtgtgatctcagctcactgcaccctccgcctctcgggttcaagcaattctcctgcatcagcctcccgagtagctggcattacaggcgcccaccaccacgctcggctaaattttttttttttttatctttagtagagacggggtttcaccacgttggccgggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattatta

SEQ ID NO: 125 - DNA, 993 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaa

SEQ ID NO: 126 - DNA, 2323 bp, Homo sapiens
accggaggcgcggccgccctgggctgagaagacgccgtcggcccaggtggcatcagaacccacaggaggaagacagccagcccagaaggagccatggggggcctctggggatcgcaagggtcgaccccatcctccctgaaacaaggccggaggttgaggaggtctccgcccggccccgcagctgacaaccggtggagaaaccgcacctgccacgggaggggccgcggggtgggctcgagccaccatggggctggtacaagcaccctctccgctcaggacctcggccctcatcccagggcaccagggctcacagggggatgggcccgggtggggacgagggtgtggaggggcaggaagcacggcgggtggagcggagccgggtgcgggggtcgcgggggaccgcggggacggggccttgtgatgcaggagacggagggggctggtgacggaggacgggaggccgcaaggatgggggacgcgacatccttttcccctcccaccggctcaccagggatgcgcctccgcgactgcccgccccaatcccagggcggaggcctcgcgcaaaacccaggcgccgcggctccgcgctccggctgagggtccgcgccgccgcccgcccgctccttcccgctcggccgcggcctcagggacggatactccagcgcgcggttccaaccgaggcccgtggcgggtttagccccatgaagatgaactgggcacccgcgaatggctgggctctgctacaggaggcagccttcctctgcgtgcggccgcggagggctccgcgggggctcgagaggggcctcgagggtgtgtgtgaggccggcgctgtgctatggtgccccgggctcctccctgcgcgtggctgcggccggggcggcgggctcaggctggagaagggccgcgggacccggggaacgcggcctggaggacgaggaggactgggttcccggaggcaacaggaccggctcggcatctacagctactgtacgtggacttcgggcgctggacccacgggcggcctgtgcctctgtgtcgggctgggtggcgccctcagtgccctggggctgctgcggccctaggcctggctgggctcggtgaccacatctggcccccgggccgcaccgtcccccaggatcctccggcctgggctcccccttcctcccttgcccacagtcttggagccccagtgggtgcaggagctgctggctgcccctgtggacccgccatccaccgtcctgcccatgctgcctcgccatccacctgcctgcccacgccgcctcagcctcccacctcccacctagaggagaccatgggccctgccccacctgctccaggatgttagggtcccctcagccaaaaaggcagtggcctgtggctcctgtaccaacagcccagccacactccagagccgcccaaagggaggtgccaaggccaggaacccaagccaccccagctccccatgcctgcccaggggccgtggtaacccatggacagggaggtgacctcaggctggttctgccactgaggccctgaggaatcaggccctccccaaaagaagtaatgaaatggaccaaaggacttaagaatttggggggaagtaaggggaaaacgttaggtgctaaccacctgcccagaagagtggatctcacagcccaggaacattcccaagcaggaaaaccatccgtccaggaaccctaaccctaaaactaagcacaacccctacccctaacccctgaccctaacgctgacccttaaccataacccttaaccctaaccactaacgcaaaacactaacccttaaccctaacccctaacacctaacccccacctcaagcactaaaccctaagcctaaaccttaaccctaactgctaacactaacccataaccctaagccctagccccaaccctaaacttgaccctgaacccaagcctccaacccaaccccgacacaaacccctaaccctaacccctaattctagccctaatccctaaatccaacaccaacccttgaccggacccctgacccctaaccctaacctcaactcataacctcaacccctactcctacacctaacccctaccctaatgctagccataaacctaacacccaaacccaaactcgaacctatgcctacccctaaaaccctagcccgaaccgtaaccacaaatcctaacacacaacgctacccctaaacctaccactaccccaccccaaaccctgacaccgaaccctgaagctaaccctaacaacactaagcctaacctgcaacccttaacccaactgtaactcctaatgctaaccctaaccctaaccctaac

SEQ ID NO: 127 - DNA, 2258 bp, Homo sapiens
tcctaagaagcactttctgccagcattgttcaacaaaggcagcctcagaagcgggtgaatgcctcatgataaagtatgtgacaaagactgtggctactgctggggaagctgccggaggaccaggccagtgggagctgagctagattatctctgaagcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatc

SEQ ID NO: 128 - DNA, 1079 bp, Homo sapiens
tacaatatcacctttcttatagattcgcatatacatggccaaaggaacaactccatgttttctaaaaggcctagagaacatacatcagaagttttaaactgtaccagtcctttcctttatgctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagattagtggaacatttcaagtaactattccaccagttttgctcgggtatacttggagtaatacttatgtatttcctaaagaagattccaatgagcagaatttaaaagaatgtacattcttaaatatttttgctaccattgaacctcaaatatcatatgtcacctgtaatccaacactagataagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtaagtatatggggaaaaaaaatcttgagttatctcctctag

SEQ ID NO: 129 - DNA, 3485 bp, Homo sapiens
aaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatg

SEQ ID NO: 130 - DNA, 2386 bp, Homo sapiens
ggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaaaaaaaaaaaaaaa

SEQ ID NO: 131 - DNA, 4126 bp, Homo sapiens
agcgggcggtatgctgaccgtacccaggcgggagccgccgcgccgccgcctggcgctgcacctgggcccggcccggccgccaattggacggctcggggcgaccccgctgtatcgcgagacgagattggcagcggcggggcctcaagtgcccccgcgctggctttgtatgcggagccgcctgccggtcctttaacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagtagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccaacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgcattttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtgtgggttttgttttgtttaatttattgattagtctttaaagtaggctttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagcaaaaaaaaaaaaaa

SEQ ID NO: 132 - DNA, 3537 bp, Homo sapiens
gcgagcgcgggcaggcggcgacgcgggggcaggggtggacggcggtcagagccgaacgcgagggcggcgcccggggactggagctgcgcgcaataggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggaccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaaaaaaaaaaaaaaaaa

SEQ ID NO: 133 - DNA, 3166 bp, Homo sapiens
gaaaagcgctggaataccaggagaaaatagtctttcaaaaggtagggcaccatcaacaccttcgcgacaggattaagagtttctagattcccaaaggtccaggctgataggtgagaggagcaactttaagagctgctagagactgagttgaaacgtttacgccagaaagacgtttggctaaggagctatggagccgggaaagggaagagctcagcggacaaggcaagtgctgcttttctttgttttcctgggagggtctttggtgtgttctgagaccgggagctattccatagcagaggaaatggaggtcggtacctttatagccaacgtggtgaaagacatgggtttggatgtggaagacctggctgcaagggggggccagagtcatctttgacgactataaaccttatttgcgattggatccacagaatggcgacttgctcttaaacgagcagctggaccgggaggcactttgtgatctcacagagccatgtatattgcatttccaggtgttatttgaaaatccgttgcaattttttcgtgctgagcttttggtcaaagacataaatgatcacactcccacgttcctaaacaatcatatgcttctaaaaatctccgaaggtgctactctaggaaccttattccaaatagatagtgcgcaggacttggatgtgggaaagaatggtgttcaaaactatacaataagtcccaatccccatttccaccttaaattacgggatagcgatgagggcagaaaatatccagagttggtactggaccaatccctggatcgagaaaaggtgtctgagtttagtttaacgctaacagccgtggatggcgggtctccgcccaggtctgggactacactgattaacgttgtggtcctggacatcagtgacaatgcccctgaatttgagaagccagtctatgaagttcatgtacctgagagcagccctctggactccttgatcatcaaagcgtctgctacagatttagatgcaggaataaatggagaactgtcttattcattttcccacgtctccagagatgtacggaaaacatttgaaatccatccaatttctggcgaagtctatttaaaagcccctctagatttcgagattattcaatcttatatcataaatattcaggccattgaaggtgggagcctttctggaaaatcaagcattttagttcgggttgtagatgtgaatgacaacccgccagaaatagccatgacatctcttaccagccccataccggaaaactcttcacctgagatggtggtcgctgttttcagcatacgagaccaagacgctggagacaatgggagaacagtttgctcaattcaggacaacctcccctttgtcttgaagcctaccttcaagaatttttacgctctggtaacagagcacccactggacagagaggtcagaaatgaatataacatcaccatcaccgtgaccgacttggggacacccaggctgaaaaccgagcacaacataaccgtgctggtctccgacgtcaatgacaacgcccccatcttcacccaaacctcctacaccctgttcgtccgcgagaacaacagccccgccctgcacatcggcagcgtcagcgctacagacagagactcaggcaccaacgcccaggtcacctactcgctgctgccgccccaggacccgcacctgcccctcacctccctggtctccatcaacgcggacaacggccacctattcgccctcaggtctttggactacgaggccctgcaggagttcgggtttcgcgtgggcgccgcagaccacggctccccggcgctgagcagcgaggtgctggtgcgcgtgctggtgctggacgccaacgacaactcgcccttcgtgctgtacccgctgcagaacggctcggcgccctgcaccgagctggtacctcgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggggcgcaccgccaggctgctgagcgagcgcgacgcggccaagcacaggctggtggtgctggtcaaggacaatggcgagcctccgcgctcggccaccgccacgctgcacgtgctcctggtggagggcttctctcagccctacctgcctctcacggaggctgccccctcccaggcccaggccgactccctcaccgtctacctggtggtggcgttggcctcggtgtcgtcgctcttcctcttctcggtgttcctgttcgtggcggtgcggctgtgcaggaggagcagggcggcctcgatgggtcgctgctcggtgcccgagtgtccctttccagggcatctggtagacgtgagcggcaccgggaccctatcccagagctaccagtacgaggtgtgtctgacgggaggctcaggggcaaatgagttcaagttcctgaagccggtgattcccaatctcctgtcccgcgacagcgaaatggagaaagccccacctttctgaatggcgtggaatgcaattagggatctgattatgatgcagaacttttagaatgagtctatttctttgaaatcttattcattgttatgcagagtttttcattttgggtaactgcattttactcaagagttttcagaagttacaagaatttaagtctattttttgttgttttaaccgtgaaaaaattgagagccggaatttgcttagtcattgttttgaaatacaacctcaaataatatattcacaaacacattattttcccttcaagtttaatcgcacactgggctcattcatattttctgagtgttctgactgtggatcctctatccaaagcagtttttatataattgagaatattattatagaggtaaatgcatgatatgaataaaaacataattgcttgttatctggttaggttggtttctgagatgttatctaatttaggtttctttcttaaaaacctataatcttttcattctacttttctggcaaacattgcagagaatttttcctgtacttagggttttttttccataattatttgtgaaccatatatatgctagtagaagttgttttatttaaataaattcaaaaccttgtttggattaagatgt

SEQ ID NO: 134 - DNA, 3203 bp, Homo sapiens
atggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacaataggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcaggctttttatgaggtgaagattctggagaatagcatccttggctccctggttgtgaccgtctcagcctgggatttagactctggaacaaacagtgaactatcctataccttttcccatgcctcagaagatattcgcaagacatttgaaattaatcaaaagtctggtgacattactttaacagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaac

SEQ ID NO: 135 - DNA, 2717 bp, Homo sapiens
gcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacaaaaaaaaaaaa

SEQ ID NO: 136 - DNA, 6453 bp, Homo sapiens
cacagggaacgggtagggtcccacggtttggggagagacatggcagtcctcaagggctgggatcagggcgcagccagggtttctgatggctttgctgatggtcaggacccaggcatgccaggcaaggcctcagcccagcagttgccaagcgtgtagccactttgggcccgtggagagagtcgcgctgcggagcccccagggggacctgaggtcacaagagcctcgatgcacctgagcgcggagctgggggtccctggagccgctgtccccacctgcggcgctggagccctggaggtgtccaggggcttccttggaacgtggagacgtgctggttaaacgtggagccccgggccagccgggcactgggggctgcaggtggagggaggtggatgctctccctcgtgggggcgtgtcttttccacaggaaagggaaagggggagggacacgggtcagcagtggggggctgtgcagtctcgcagatcttcacccttggttcttgaactctggaccctgagccctgccgagggtcccgcaaaggtgggcaaggagctcccggctgcttggtctccgcagtgttggggctgccagcagggggacgctgggcccccggggacctgacccgtgctccctccccaccccgcagtctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttc

SEQ ID NO: 137 - DNA, 5019 bp, Homo sapiens
gcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacggcctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgct

SEQ ID NO: 138 - DNA, 1356 bp, Homo sapiens
ccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaacgaacctgcctag

SEQ ID NO: 139 - DNA, 2307 bp, Homo sapiens
gtgactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttctgt

SEQ ID NO: 140 - DNA, 923 bp, Homo sapiens
gggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactgtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctcttggaagttaacagactcatgtgaactggaatgtacgttgtggccctcacaattgattttaatatttatttgcaaagtcctttctgtttctaaataaaagctgtgccttctgaaaaaaaaaaaaaaaaaaaaaaaa

SEQ ID NO: 141 - DNA, 3443 bp, Homo sapiens
agtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcaccttggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcccacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaagtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgct

SEQ ID NO: 142 - DNA, 1955 bp, Homo sapiens
atgagtggcatgttggagagacagagcagggaccttgtggcatcatgtgtggcagatggaagaaatgagaacacagaggctcaaagaggtcggctggtggaggccattgttagccaaggagagagtctgggtttgtggggagcgccgggacaccggctgacgagggctaatgcgtgggctgtgaaggtctccccgggtgccgtggaccagtttcccatctcctcgcggctggctgccttcctgactccgataacgtcatgtgtgcacacacagccctccgggctgtgctggcacctctatgtcacccccattaccgagggcatctctggcagcctcagtagagcccttgctcccatcagatccaaaggctcctcttctgggggccccggtgccccacacacctcggatgtgccaggggcctcatttcccagaattgacctgacaaatattgaccaggttgctgtcatcttcaaacaccattttcctgtgggtagaggtgatgcagtgctgaagacctgggcccctgctcagtgcctttgctctagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacacccttgccctgcccagccccaaactcgaactaaaagtaggaaactccctgttcctagacaagcgactaaagcctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaagccaagtggaagcaccctttcagtcgctaccagacccagaagcaggaaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggaggctgctctgcagccacagaccctgagaaaatggggccaattgctcctgcccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttctgtg

SEQ ID NO: 143 - DNA, 1697 bp, Homo sapiens
ggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactcagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatcccaccagtggggaaacattagaagaaaatgaagctggggactgaggtgcgtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaacgaaaaaaagaaattgaataataaaatcaggagtcaaaattcatcgtcttcaaggcccctctttctagccttttctactactctctgcttggtcaaggtttgtgccccactacagaacagggctaaattagccaccaccactgaaaactcagccgaatttttttataccactctgacgtcagcatttttt

SEQ ID NO: 144 - DNA, 3575 bp, Homo sapiens
cgggaggaggtcccccgacatgcctgaggcaaaaccagcggccaaaaaggcccccaaaggcaaagatgcccccaaaggagcccccaaggaggctccccctaaggaggctcctgcagaggcccccaaagaagccccacccgaggaccagtccccgactgcagaggagcccaccggcgttttcctgaagaagccggactccgtctcagtggagactgggaaggacgcagtggtcgtggccaaggtgaacgggaaggagctcccagacaaaccgaccatcaagtggttcaaggggaagtggctggagctgggcagcaagagtggcgcccgcttctccttcaaggagtcccacaactccgccagcaatgtgtacaccgtggagctgcacattgggaaggtggtactgggggaccgtgggtattaccgcctcgaggtcaaagccaaggacacctgtgacagctgtggcttcaacatcgatgtggaggcaccccgtcaggatgcctctgggcagagtctagaaagcttcaagcgtacgagtgaaaagaagtcggatactgcaggtgagctggatttcagtggcctgttgaagaagagggaggtggtggaggaggagaagaagaagaaaaagaaagatgacgatgacctaggcatccccccggagatttgggagctcctgaaaggggcaaagaagagcgagtacgagaaaatcgccttccagtatggcatcaccgacctccggggcatgctgaagcggctgaaaaaggctaaggtcgaggtcaagaagagtgcagcattcacaaagaagctggatccagcctaccaagtggacagaggcaacaagatcaagttgatggtagagatcagcgacccagacctgaccctcaagtggttcaagaacggccaggagatcaaaccaagcagcaagtacgtgtttgagaacgttggtaagaagcgaattcttaccatcaacaagtgcacgctggcggatgacgctgcctatgaagtagctgtcaaggatgagaagtgtttcaccgagctcttcgtcaaagaacctccagtcctaattgtcacacctcttgaggaccagcaggtgtttgtgggtgaccgggtggaaatggcagtggaggtgtcagaagagggtgcccaggtgatgtggatgaaagatggtgtggaactgactcgggaggattccttcaaggcccggtaccgcttcaagaaggacgggaagcgccacatcctcatcttctcagacgtggtccaggaggacaggggtcgctatcaggtcataaccaatggcggccagtgtgaggccgagctgattgtggaagagaaacagctggaggtcctgcaggacatcgcggatctgacggtgaaggcctcagaacaagctgtgttcaagtgcgaggtgtctgatgagaaagtgacgggcaagtggtataagaatggggtcgaggtgcggcccagcaagaggatcaccatttcccatgtaggcaggttccacaagctggtgatcgatgacgtccgccccgaggatgagggagactacacgtttgtgcctgacggctacgcccttggttcgctctcggccaagctcaacttcctggaaatcaaggtggagtacgttcccaagcaagagccaccaaagatccacttggattgctcggggaagacctcagagaatgcgattgtggttgtggctggaaacaagctgaggcttgacgtgtccatcacaggggagccccctcccgtcgctacctggctgaagggagatgaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtagatgtcccagaccccccggaggctgtgcgcatcacctcggttggagaggattgggccatccttgtctgggagccaccaatgtacgatggggggaagccagtcaccgggtacctcgtagagcggaagaagaagggctctcagcgctggatgaagctgaactttgaggtcttcacagagaccacctatgagtccaccaagatgatcgagggcatcctctatgagatgcgtgtcttcgccgtcaatgctataggggtctcccagcccagcatgaacaccaagccttttatgcctattgcacccacgagtgaacccctgcacctgatagtggaggatgtgacagacaccaccaccacactcaagtggaggcctccgaacaggatcggggcaggtggcatcgatgggtacctggtggagtactgcctggaaggctccgaggaatgggtccctgccaacaccgagcccgtggagcgctgtggcttcaccgtcaagaatctcccgaccggagccagaatcctcttccgagtagttggggtcaacatcgcggggcgcacggagccggccaccctggcccagccggtcaccatcagggagattgcggagccacccaagatccggcttccccgccatctccgccagacctacatccgcaaagtgggcgagcagctcaaccttgtcgtccccttccagggaaagccccggccccaggtggtgtggaccaagggcggggccccgctggacacctcccgcgtgcacgtgcggaccagcgacttcgacaccgtgttcttcgtgcgccaggcggcccgctccgactccggggagtacgagctgagcgtgcagatcgagaacatgaaggacaccgccaccatccgcatccgcgttgtggaaaaggctgggccccccataaacgtgatggtgaaggaggtgtggggcacgaacgcgctggtggagtggcaggcccccaaagatgatgggaacagtgagatcatggggtatttcgtccagaaagcagacaaaaaaaccatggagtggttcaacgtctatgaacgtaacaggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgtgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctggaaaaaaaaaaaa

SEQ ID NO: 145 - DNA, 987 bp, Homo sapiens
gtgagcgtgtgagttgtagcgtaccctggggtctgttctggaggaggcctgagagcggggttgcctggggcgtgggtctctcatccctctcgtcctggtgaagaagaagagtatacccagcggcagctggcttggctttttcagaggaaacagagactctcagacatgaatactgtgacactgaccaccaggccaacttaacatcagcagatatcctgtctcagatgaagagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctc

SEQ ID NO: 146 - DNA, 1641 bp, Homo sapiens
aagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaatgctcagtggcg

SEQ ID NO: 147 - DNA, 717 bp, Homo sapiens
attactgcaggaaaaggtcccggagagctgagcagtcaagatgtgtgacttcaccgaagaccagaccgcagatctgatcccaagcactgagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcgagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 148 - DNA, 2733 bp, Homo sapiens
aagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaggagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaatactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcggggggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagccgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 149 - DNA, 4220 bp, Homo sapiens
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgccccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcggccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattgaaaggaacccacttaataaagacatttacttctttaatatattcttgttggctaactaaattgtgtatgcccaccacaaagaaggtactattttttgtttgattcatcttcaactttgcgtattatgcttaacttcacaagttaactttttcttattttgtatcctgatgaggcatttcttactagaatcccataagtgaaatataatatttttcaaagttgatatcatttaaaaatttttggtcgttttaaatgtctttattgactttaaattcattgcctctacattattcattagttcttcttttcctaaaactttttacttgttaaaatagtctgctgcatgtaatatgtgcttttactatttgatatttcttctatttttcttttgaaaccggtgttcttattggtttgccatccttgttcattacaactgttttttgtttgtttgtttgttttttggtttgtttgttttttttttttttgagacggagtctcgctctgtcgcccaggctggagtgcagtggcgcgatctcagctcactgcaacctccgcctcccaggttcaagcgattctcctgcctcagcctccagagtatctgggactacagttgcatgtcaccacgttcggctaatttttgtattttcagtagagacgggtttcatcatggtggccaggatggtctatctcttgacctcgtgatccaccccactcagcctcccaaattgctgggatttacaggcatgagccaccgcacccagcctacaataattttcttaaactttaccttttattttaaagttctagtttcccggcattgatagttccctatttgaaatataatgtttctcttgtaagtgatatgataaataaacccctaattagccttagaagaaaaaccactgcaagatattaagcgtgtgtaaatgggctttagtctggaaaccaaaaaaaaaaaaaaaatttagtcattctataggatcatgtgaaaatatttaatttgctccttttaattctgtataaacaaatcagaggttcctgaggttcctgttaaatttttaatggctaatagcccagtgccatccagttgaaaaaacaacagcaatcacaaagtagaggtttatattgtgcggcttttatattcagctattagagtgttattggtagtgtctagccttttcctccacgacattccttgacttaatccatttgggcctattatagacaaaatagagcttctttctagatataaggtctttgaggcagggctcagtggctcattcctgtaatcccagcactttgggaggccaaggcgggcagatcaccttaggtcacgagtttgagaccagcctgaccaacgttaagtaaccccgtctttactaaaaatacaaaattagccaggcatggtggcacatgcttgtaatcccagctactcgggaggctgaggcaggagaatcgcttgaacccaggaggtggaagttgctttgagccgagattgcaccattgtactccagcctgggcaataagagcaaaactccatcaaaataaaataaaataaaatataaaataacttaaaaagaactttgaataaaattctatgaaaaaagacactagaatgctgttcttaattttaatagtgttaagataggtgttagtgtggtctgttctttacctccctttatttggtgcagagaagttagatcctgctaaatttcaattaagaggggaccttaaaataaggatcaatctcttatttaaccctgtaagttactttaaagctaatacaagaaaaacaaagacaagtgaaagtaaggaaacagaaattgc

SEQ ID NO: 150 - DNA, 1401 bp, Homo sapiens
atgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaattcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtgcccagaaatcttcctctggcctagttgtggagcctggcctaagtcgcacattgctggagatggtgaagctgaccagcatgagaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtga

SEQ ID NO: 151 - DNA, 778 bp, Homo sapiens
gagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 152 - DNA, 1584 bp, Homo sapiens
aagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcttgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaccaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaaa

SEQ ID NO: 153 - DNA, 2181 bp, Homo sapiens
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaaaaaaaaaa

SEQ ID NO: 154 - DNA, 1476 bp, Homo sapiens
actgtacacatgctagggtccaggacagcaggaccaagccagcagaaacagcctcagcctaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgactatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcagagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgaccttggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 155 - DNA, 3971 bp, Homo sapiens
gctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactcccctcagcccacagtgcaaccagttcacagggcagtgccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcggcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttgg

SEQ ID NO: 156 - DNA, 3579 bp, Homo sapiens
caccacagttatcacccatgccctcctaaaagggtgtctcaaagcatatctttctgtagagcagaattcggaactgagaagacgagggctcaaattgaatctcacaggatttgcgtgcaagagaaacccaaaggaatggattggctcttcttcagaaacatttgccttttgatcattctaatggtggtgatggaagtaaacagtgaatttattgttgaggtgaaggaatttgacattgaaaatggcactacaaaatggcaaacagtcagaagacaaaagcgggagtggatcaagtttgccgcagcctgtcgagaaggagaggacaactcgaagaggaaccccattgccaaaattcgatcagactgcgaatcgaaccagaagataacataccggatttctggagtagggattgatcgaccaccatatggggtattcaccattaatcctcgcactggggaaattaacatcacttcagtggtagacagagaaataactccacttttcttgatctattgccgggctctgaattcacggggtgaagatttagaaaggcctcttgagcttagagtcaaagttatggacataaatgataacgctccagtcttttcgcaaagtgtatacacagccagcattgaagaaaatagtgatgccaatacattggtagtaaagttatgtgccacagatgcagatgaagaaaatcatctgaattctaaaattgcctacaagatcgtctctcaggagccatcaggtgcacccatgttcattctgaataggtacactggagaagtctgcaccatgtccagtttcttggacagagagcaacacagtatgtacaacctggttgtgagaggctcagatcgggatggagctgcagatggactgtcttctgagtgtgactgtagaatcaaggttttagacgtcaacgataatttccccaccttagagaaaacttcatactcagccagtattgaagagaattgtttaagttcggaactgatacgattacaagcaattgatcttgatgaagaaggcactgataactggttggctcaatatttaattctctctggaaatgatgggaattggttcgatattcaaacagatccacaaaccaatgaaggcattttgaaagttgtcaagatgctggattatgaacaagcacctaacattcagcttagtatcggagttaaaaaccaagctgattttcactactccgttgcttctcaattccaaatgcacccaacccctgtgagaattcaagttgttgatgtgagagaaggacctgcatttcatccaagtactatggcttttagtgtgcgggaaggaataaaaggaagttccttattgaattatgtgcttggcacatatacagccatagatttggacacaggaaaccctgcaacagatgtcagatatatcatagggcatgatgcaggcagctggttaaaaattgattcaagaactggtgagatacaattttctagagaatttgataagaagtcaaaatatattatcaatgggatatacacagcagagatcctggctatagatgatggctctggaaaaacagctacaggaaccatatgtattgaggttcctgatatcaatgattattgtccaaacatttttcctgaaagaagaaccatctgcattgactctccatcagtccttatctctgttaatgaacattcttatgggtctccgtttactttctgtgttgttgatgagccaccaggaatagctgacatgtgggatgtcagatcaacaaatgctacctcggcaatccttacggctaagcaggttttatctccaggattttatgaaatcccaatcctggtgaaggacagctataacagagcatgtgaattggcacaaatggtgcagttatatgcctgtgattgcgatgacaaccacatgtgcctggactctggtgccgcgggcatctacacagaggacataactggtgacacgtatgggcctgtcactgaagaccaagctggagtttcaaatgttggtcttggaccagcagggattggcatgatggttctgggcatcctgctactgattttggctccactcttgctgctcctgtgttgctgcaaacagagacagccagaaggcctgggaacaagatttgctcctgtgcctgagggcggagaaggagtgatgcagtcttggagaattgaaggggcccatcccgaggacagggatgtgtcaaatatatgtgcacccatgacagcctcaaatacccaggatcggatggattcctctgaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatggggatattattgtgactgagacttacggtaatgctgatccatgtgtgcaacccactacaattatttttgatcctcagcttgcacccaatgttgtagtaaccgaagcagtaatggcacctgtctatgatattcaagggaatatttgtgtacctgctgagttagcagattacaacaatgtaatctatgctgagagagtactggctagtcctggtgtgcctgacatgagcaatagtagcacgactgagggttgtatgggacctgtgatgagcggcaatattttagtagggccagaaattcaagtgatgcaaatgatgagtccagaccttcccataggccaaaccgttggctccacatcccccatgacatctcgacacagagtaacacgatacagtaacatacattacacccaacagtaagtgctttatggtcagtattctatgtggagaccttgcaccttgtaatcatcaatacatccaccaaaaatatataatgtaccatatatattaatagtcaacaaatactcagatattctaaggtcaatgccattatttgattataccattttgagggtgaatatggctaggcactttagataagcctttttaaaattctttctgattttaaataatgcgtcaaaaaatgtgcagaaaatgtattgcatcccttgatactgtctaacgaatagcacataactcatattgtgaatcctatgggtcttgaggcctgtagaaccaatc

SEQ ID NO: 157 - DNA, 4559 bp, Homo sapiens
catgaggctggcgagctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaaaaaaaaaaaaaaaaaaa

SEQ ID NO: 158 - DNA, 1851 bp, Homo sapiens
  modified_base (1180): a, c, g, t, unknown, or other
  modified_base (1218): a, c, g, t, unknown, or other
  modified_base (1221): a, c, g, t, unknown, or other
ccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcntcctctctgggggtggtggcatttaaggttcaacccanccnagaagtgctgcgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctcctctatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtttaaaaaaaaaaaaaaaaaaaaaaaaaaaaaaaaaaa

SEQ ID NO: 159 - DNA, 2623 bp, Homo sapiens
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgggaaatgggcatacagtactgagaaatgggagcacagtactgggaaatgggagcacagtactgggaaatgggagcccacagtactgggaaaggggagttcacagtactcggaaatgggagcatagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtg

SEQ ID NO: 160 - DNA, 3100 bp, Homo sapiens
atggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaaaaaaaaaaaaaaaaaa

SEQ ID NO: 161 - DNA, 4975 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 162 - DNA, 4512 bp, Homo sapiens
cccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaaggaaaagaacagagaagaacaaacaaaactcccttggtcttggatgtaagagaatccagcagagatggactggagtttcttcagagtagttgcagtgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggtggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaactaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaatatccctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaagaagcagcagcttgtagtatgcttaagctttggggaatttttttttaaggggatctaaaaaaatgtttttagaacatgtaaaatgtttaatggtgaaagttggaaaa

SEQ ID NO: 163 - DNA, 1417 bp, Homo sapiens
ccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttgggatgcttctgtttgcggggacggtcggtgcagctgcaaggctggaggcggccggcagtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaaaaaaaaaaaaaaaaa

SEQ ID NO: 164 - DNA, 1438 bp, Homo sapiens
gggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccattgaaaaaaaaaaaaaaaaaaaaaaaaaaaaaaaaaaaaaaaaaaaaaaa

SEQ ID NO: 165 - DNA, 672 bp, Homo sapiens
caccaaatccaaacaatcaggccacaaacccgtcaagagctcgccggtctggccgtccagtcgccgcccgccttgagactcagcctgagctacagcttcgaaactagcctctagccttctgggtctcagcacaactcttgagcaatccaaccctgtggccgtgggcagataccaagatgcacagttaccgtgtggccagctgccaagcgccactacttgcacctgaagtcgcagccccgcgctgcgcacccagtcgaggcgccaacacgcgaactgggcgggagtggccggcccgcgggggagcgaggaacgacagggttccccccactcgctgcccagactggccgcgggatagcgcgccccccccaaagcctgcacccctgccctgctcctctatcattccgtcccccttgctctgtcaaaccctgccggggctgctctgtctctgccgacccgccacttgcccgaagttcggcctgaggagcttggggccctgaggagcgccgacgtaggcagccagccagtcaatcagtcagagggtcacggcggcccctcggctactcagtggcagccaggccagaaagaagcagccgccaaccctggagcagaatcctacagccgacctgacctagtaggcccccagccctccagagcttggggtattgcagagcc

SEQ ID NO: 166 - DNA, 5879 bp, Homo sapiens
ggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagccagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcataaagtaatatttacagatgtggggagatgtaataaaacaatattaacttggaaaaaaaaaaaaaaaaaaa

SEQ ID NO: 167 - DNA, 2661 bp, Homo sapiens
atggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagtgttactgaaaaaacctttggaagtatttcgagctgaactactagtgacagacataaacgatcattctcctgagtttcctgaaagagaaatgaccctgaaaatcccagaaactagctcccttgggactgtgtttcctctgaaaaaagctcgggacttggacgtgggcagcaataatgttcaaaactacaatatttctcccaattctcatttccatgtttccactcgcacccgaggggatggcaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaactagattttgagacaatgtcttcgtatgatctagatatagaggcatctgatggcgggggactttctggaaaatgctctgtctctgttaaggtgctggatgttaacgataacttcccggaactaagtatttcatcacttaccagccctattcccgagaattctccagagacagaagtggccctgtttaggattagagaccgagactctggggaaaatggaaaaatgatttgctcaattcaggatgatgttccttttaagctaaaaccttctgttgagaatttctacaggctggtaacagaaggggcgctggacagagagaccagagccgagtacaacatcaccatcaccatcacagacttggggactccaaggctgaaaaccgagcagagcataaccgtgctggtgtcggacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccgggacccgcacctgcccctcacctccctggtctccattaacacggacaacggccacctgttcgctctccagtcgctggactacgaggccctgcaggctttcgagttccgcgtgggcgccacagaccgcggcttcccggcgctgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgtggccaagcacaggctagtggtgctggtcaaggacaatggcgagcctccgcgctcggccaccgccacgctgcaagtgctcctggtggacggcttctctcagccctacctgccgctcccagaggcggccccggcccaagcccaggccgactcgcttaccgtctacctggtggtggcattggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcaccttagttttttttaaccctttagtaatcttgaattctacttttttttaaatttctactgttgtctttagtaatgttactcatttcctttgtctgattgttagttttcaaattattgtattattataaatattttatatcaggaaagttcatatttctgaataaattaatagtattcattcctgaagggtgatatgaaagttaaccccacctaataaacataactctaattctgaaaaaaaa

SEQ ID NO: 168 - DNA, 1237 bp, Homo sapiens
atgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgcccaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatcttaactttatggaagggcctctattttacatcatataatttctgcccataattgtattgaaataggaaagttgctgctcttgcacttgctggaatgtacagggtgggctggttggccctatgtacctaatctgaaaaactaaatatcgttctgtcagggcctttgcataaagccatttgtgtgtacatgca

SEQ ID NO: 169 - DNA, 2683 bp, Homo sapiens
atggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 170 - DNA, 1444 bp, Homo sapiens
ccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagtgcttccagagtcccaagagcttctctgggattttcttgtgatatctgattccccagtgaggcctgggacctttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 171 - DNA, 3282 bp, Homo sapiens
atgtatgtggccaatggtagccacagagctgctttgctcagagtcctcctgctggccttactggtagcccagaacctggcaagcagtcagttgacccctgctcctgtccagaagaaaatctgtgctactttctcctgccaaggtggtgactgtttcaaagggccgaaagctgtggccatgtgccctgagggcttggacttctgtgaggggctgttgggaaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttc

SEQ ID NO: 172 - protein, 461 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 173 - protein, 795 aa, Homo sapiens
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 174 - protein, 797 aa, Homo sapiens
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 175 - protein, 444 aa, Homo sapiens
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 176 - protein, 177 aa, Homo sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEGLARSCACTSSCWGY

SEQ ID NO: 177 - protein, 270 aa, Homo sapiens
MRAAVAASVGLSEGPAGSRSGRLFRPPSPAPAAPGARLLRLPGSGAVQAASPERAGWTEALRAAVAELRAGAVVAVPTDTLYGLACAASCSAALRAVYRLKGRSEAKPLAVCLGRVADVYRYCRVRVPEGLLKDLLPGPVTLVMERSEELNKDLNPFTPLVGIRIPDHAFMQDLAQMFEGPLALTSANLSSQASSLNVEEFQDLWPQLSLVIDGGQIGDGQSPECRLGSTVVDLSVPGKFGIIRPGCALESTTAILQQKYGLLPSHASYL

SEQ ID NO: 178 - protein, 1017 aa, Homo sapiens
MYVANGSHRAALLRVLLLALLVAQNLASSQLTPAPVQKKICATFSCQGGDCFKGPKAVAMCPEGLDFCEGLLGNVVTVPEPGAAESRAPCGDSSGGCVRSAGASMDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 179 - protein, 1049 aa, Homo sapiens
MDWSFFRVVAVLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 180 - protein, 757 aa, Homo sapiens
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 181 - protein, 1058 aa, Homo sapiens
MAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGP

SEQ ID NO: 182 - protein, 233 aa, Homo sapiens
MKGYQSLVFNFFFLKLSAENESTPIQQLLDHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKVVLCGHRERVPRGPRLSVCLSFWVGAV

SEQ ID NO: 183 - protein, 25 aa, Homo sapiens [sequence omitted]

SEQ ID NO: 184 - protein, 126 aa, Homo sapiens [sequence omitted]

SEQ ID NO: 185 - protein, 170 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 186 - protein, 999 aa, Homo sapiens
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSASGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 187 - protein, 1437 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 188 - protein, 466 aa, Homo sapiens
MTPGSTKHLHVPLLIPHSPPPRVAHPARAGCAHPKAALLGAPELPDRAVAQFCGICSNTRERTIHMAIGLLMAQEGHCKDSSAMGEEAHHPLTPATPPFPPLSPDWGHMQPDFFVPVAVPAVFRGPPQLQCHGRRLFLNSPCAQKSSSGLVVEPGLSRTLLEMVKLTSMRGLCCLVPSSLVEDPQEDAAQKTDTSHHDQGDWEDLACQKISYNVTDLAFDLYKELADLSQTSNVLVTPTSVAMAFAMLSLGTKADTRTEILEGLNVNLTETPEAKIHECFQQVLQALSRPDTRLQLTTGSSLFVNKSMKLVDTFLEDTKKLYHSEASSINFRDTEEAKEQINNYVEKRTGRKVVDLVKHLKKDTSLALVDYISFHGKWKDKFKAERIMVEGFHVDDKTIIRVPMINHLGRFDIHRDRELSSWVLAQHYVGNATAFFILPDPKKMWQLEEKLTYSHLENIQRAFDIR

SEQ ID NO: 189 - protein, 370 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKVS

SEQ ID NO: 190 - protein, 770 aa, Homo sapiens
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRYPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRNNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELTTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 191 - protein, 235 aa, Homo sapiens
MITGSPQMTWCPPFWTPPISTASRYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 192 - protein, 1015 aa, Homo sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 193 - protein, 98 aa, Homo sapiens
MVQLTIAKSQVCLYQQHENGLIVPVEWGIAEKIPENVEATLELGVEIIWRAQKKIGKCRKVWNLLETVNGIDKNTDSDMNNKVQAEVVSDGDEDLVGN

SEQ ID NO: 194 - protein, 280 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRSSRANTVTPAVGRLEVSMVKPTPGLTPRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 195 - protein, 103 aa, Homo sapiens
METVQELIPLAKEMMAQKRKGKMVKLYVLGSVLALFGVVLGLMETVCSPFTAARRLRDQEAAVAELQAALERQALQKQALQEKGKQQDTVLGGRALSNRQHAS

SEQ ID NO: 196 - protein, 292 aa, Homo sapiens
MTEKHEDHCLKSCSGHSYIRKNWLGCIVFPFSALLQQSEISGTFQVTIPPVLLGYTWSNTYVFPKEDSNEQNLKECTFLNIFATIEPQISYVTCNPTLDKFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNVSIWGKKILSYLL

SEQ ID NO: 197 - protein, 727 aa, Homo sapiens
MRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 198 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMGGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGGSCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 199 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 200 - protein, 178 aa, Homo sapiens
MLKALTDATKLSNENSEINQLTRKSLQDYYWQISNTKQMYDLERGKDLSLLHSILRTWKQIKSLRHGQGFTSTPIKLQVQRIKMNKCDEQEQISEMSETEKKNEGKELKNGKKLEDTHIKRLSKQGEEYRSHKMKVGGREKKEEEEDICAGKPRLKLSGSQGKRMYGVLYLCKAIAIR

SEQ ID NO: 201 - protein, 219 aa, Homo sapiens
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGK

SEQ ID NO: 202 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 203 - protein, 326 aa, Homo sapiens
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 204 - protein, 476 aa, Homo sapiens [sequence omitted]

SEQ ID NO: 205 - protein, 833 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGTFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 206 - protein, 497 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLARGHAPHCPGACQRVEQGCAEFTDVLLGPPPPGYHPFLFLDSLHKKAGGRSRGGLHPRGTPPTAQEPPGGSRPEGRATEEQAAAAHLGEYVLMIRDVTTPPFLGRRLPPAFKHLRVVAKRAGQPPHVLEEGPEASSSWQAAHSCTPEPPAPR

SEQ ID NO: 207 - protein, 266 aa, Homo sapiens
MHPTAPVPEPSSSTNRRLSVWAQSPENSGVSRLGSAASSGECALTRGPGPVSVTLRESRSSSARQAPDGVCRVRFLGISRRPFPRGSGAAWGAGEGGRGMGDLGLEGQAPPPAAQAARRLFFRGSRGLTQAPAPVAPKLAVRWALRCTRRAVPPRLAATWSAPPASCVPSPPALRGQAGRRPRRALPGAQSAWEARGRAGGHGAARWEVARRLQERTVGHGPAAAPRLHRSVPGAALRLRHPHGSAHAQGSGRTPGAGPGPGAGAL

SEQ ID NO: 208 - protein, 141 aa, Homo sapiens
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 209 - protein, 208 aa, Homo sapiens
MPPKKDVPVKKPAGPSISKPAAKPAAAGAPPAKTKAEPAVPQAPQKTQEPPVDLSKVVIEFNKDQLEEFKEAFELFDRVGDGKILYSQCGDVMRALGQNPTNAEVLKVLGNPKSDELKSRRVDFETFLPMLQAVAKNRGQGTYEDYLEGFRVFDKEGNGKVMGAELRHVLTTLGEKMTEEEVETVLAGHEDSNGCINYEAFLKHILSV

SEQ ID NO: 210 - protein, 791 aa, Homo sapiens
MPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 211 - protein, 787 aa, Homo sapiens
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 212 - protein, 754 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 213 - protein, 396 aa, Homo sapiens
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRREEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 214 - protein, 412 aa, Homo sapiens
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTAREGDEDPCPSALGAKARNSRLICRRLCQFSTRVHPDGGSMAQEADDAPSISTLGLQQETTEPMKTDSAESED

SEQ ID NO: 215 - protein, 434 aa, Homo sapiens
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 216 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIDQNTKSPLFMGKVVNPTQK

SEQ ID NO: 217 - protein, 341 aa, Homo sapiens
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 218 - protein, 606 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 219 - protein, 1040 aa, Homo sapiens
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRDVSNICAPMTASNTQDRMDSSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 220 - protein, 1104 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 221 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 222 - protein, 543 aa, Homo sapiens
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQDNKNLSVIWCLFEWQLLDHCIAGVEGLLPPSSRTGVSRICV

SEQ ID NO: 223 - protein, 282 aa, Homo sapiens
MEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 224 - protein, 414 aa, Homo sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 225 - protein, 1017 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 226 - protein, 171 aa, Homo sapiens
MLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 227 - protein, 901 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 228 - protein, 266 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPALRRRPSLSAWRWNRPRRPRTPRSRSPSSPNTGTSSWGGPCCSQPCVLLRQGPRHRHRRPDGCTSFPSSCSS

SEQ ID NO: 229 - protein, 747 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 230 - protein, 753 aa, Homo sapiens
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISPDQIHLTINPGSTPMPRNIEGATLTLQSECPETKRKEVKRYQCTFEGCPRTYSTAGNLRTHQKTHRGEYTFVCNQEGCGKAFLTSHSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEDTNHSLCLSDLSLLSTDSELRENSSTTQGQDLSTISPAIIFESMFQNSDDTAIQEDPQQTASLTESFNGDAESVSDVPPSTGNSASLSLPLVLQPGLSEPPQPLLPASAPSAPPPAPSLGPGSQQAAFGNPPALLQPPEVPVPHSTQFAANHQEFLPHPQAPQPIVPGLSVVAGASASAAAVASAVAAPAPPQSTTEPLPAMVQTLPLGANSVLTNNPTITITPTPNTAILQSSLVMGEQNLQWILNGATSSPQNQEQIQQASKVEKVFFTTAVPVASSPGSSVQQIGLSVPVIIIKQEEACQCQCACRDSAKERASSRRKGCSSPPPPEPSPQAPDGPSLQLPAQTFSSAPVPGSSSSTLPSSCEQSRQAETPSDPQTETLSAMDVSEFLSLQSLDTPSNLIPIEALLQGEEEMGLTSSFSK

SEQ ID NO: 231 - protein, 896 aa, Homo sapiens
MAAAGPRRSVRGAVCLHLLLTLVIFSRDGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 232 - protein, 834 aa, Homo sapiens
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFRRLMPFRLSSKSVDSFLQADGPEERPPAALPESTHM

SEQ ID NO: 233 - protein, 394 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENPTSGETLEENEAGD

SEQ ID NO: 234 - protein, 596 aa, Homo sapiens
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 235 - protein, 707 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 236 - protein, 295 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPEGRCSCSAGFQERGDFCEGIQLAGGRGVGV

SEQ ID NO: 237 - protein, 175 aa, Homo sapiens
MWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQGPFKW

SEQ ID NO: 238 - protein, 305 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKPQSQAQVEPVGLEMFLKAAAENQEYLIDKYLTDGGDPNAHDKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 239 - protein, 120 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRVHEDAHLFIQRVWISHMFVQRV

SEQ ID NO: 240 - protein, 797 aa, Homo sapiens
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNAPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLLSVLLFVAVRLCRRSRAASVGRCSVPEGPFPGHLVDVSGTGTLFQSYQYEVCLTGGSETGEFKFLKPITPHLPPHRGGKEIEENSTLPNSFGFNY

SEQ ID NO: 241 - protein, 798 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 242 - protein, 213 aa, Homo sapiens [sequence omitted]

SEQ ID NO: 243 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 244 - protein, 1361 aa, Homo sapiens
MERSAANPAPWPSLVRPSADPAGLRSLPLVSGKAQIPPPQRALPVALRSAFRQYPDGSVMAAIRDSQELGGSRRRCASALPAGQPNPGGRGGSGAVFGAKLGARRSKHSLGGFRGWWRQQGRPADRTPRAIGSQARLDGVPIAGPAYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCSRRNQPVVVLNHPDADAPEVVSVMKTIAKFNGHVLKVSLSKRTINALLKPVCYNPPKTTYDDFSKRHKTFKPVSSVKERFVLKLTLKKTSKNNYQIVKTTSENILKAKFNCWFCGRVFDNQDTWAGHGQRHLMEATRDWNMLE

SEQ ID NO: 245 - protein, 301 aa, Homo sapiens
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 246 - protein, 348 aa, Homo sapiens
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 247 - protein, 847 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLMNKTELLFDTIDSSEANVAKSIAKFLRNVRYRYQPLLERCNNVFLSNVDHLDLDSISKILSVYKFLQFNSFEFIIMAKKKPTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 248 - protein, 280 aa, Homo sapiens
MSESFDCAKCNESLYGRKYIQTDSGPYCVPCYDNTFANTCAECQQLIGHDSRELFYEDRHFHEGCFRCCRCQRSLADEPFTRQDSELLCNDCYCSAFSSQCSACGETVMPGSRKLEYGGQTWHEHCFLCIGCEQPLGSRPFVPDKGAHYCVPCYENNFAPRCARCTKTLTQGGLTYRDLPWHPKCLVCTGCQTPLAGQQFTSRDEDPYCVACFGELFAPKCSSCKRPIVGLGGGKYVSFEDRHWHHNCFTCDRCSNSLVGQGFVPDGDQVLCQGCSQAGP

SEQ ID NO: 249 - protein, 509 aa, Homo sapiens
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIGAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 250 - protein, 1107 aa, Homo sapiens
MDGKRRPGPGPGVPPKRARGGLWDDDDAPWPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSHTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 251 - protein, 604 aa, Homo sapiens [sequence omitted]

SEQ ID NO: 252 - protein, 458 aa, Homo sapiens
MDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCVEIVELKQHLEHYDKIQELTQMLQESHSSLVSTNEHLLQELSQVRAQHRAEVEQMHWSYQELKKTMALFPHSSASHGGCQAC

SEQ ID NO: 253 - protein, 203 aa, Homo sapiens
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 254 - protein, 276 aa, Homo sapiens [sequence omitted]

SEQ ID NO: 255 - protein, 183 aa, Homo sapiens
MATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEITRLLLSHGSNPRVVDDDGMTSLHKAAERGHGDICSLLLQHSPALKAIRDRKARLACDLLPCNSDLRDLLSS

SEQ ID NO: 256 - protein, 456 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 257 - protein, 130 aa, Homo sapiens
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 258 - protein, 405 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 259 - protein, 776 aa, Homo sapiens
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALREFEFRVSATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYLVVALASVSSLFLFSVLLFVAVRLCRRSRAASVGRCSMPEGPFPGRLVDVSGTGTLSQSYQYEVCLTGGSETSEFKFLKPIIPNFSP

SEQ ID NO: 260 - protein, 155 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 261 - protein, 1142 aa, Homo sapiens
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALGSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRTEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 262 - protein, 1172 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSPQPTVQPVHRAVPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKLCGNSRQMACTPISCPGELCPQDNGTACGSRCRGVLPRAGGAFLMAGQVAEQLRGFNAQLQRTRQMIRAAEESASQIQSSAQRLETQVSASRSQMEEDVRRTRLLIQQVRDFLTDPDTDAATIQEVSEAVLALWLPTDSATVLQKMNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKDRLGQSSMLGEQGARIQSVKTEAEELFGETMEMMDRMKDMELELLRGSQAIMLRSADLTGLEKRVEQIRDHINGRVLYYATCK

SEQ ID NO: 263 - protein, 798 aa, Homo sapiens
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 264 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 265 - protein, 206 aa, Homo sapiens
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWDASVCGDGRCSCKAGGGRQCPVLAADAALTFSPHLKACGYQGHPCGYGLYFLRRFQRPGVLADSGDVLHHALLYHDEEANQAHD

SEQ ID NO: 266 - protein, 802 aa, Homo sapiens
MKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPTLSEKKHQDFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLCDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 267 - protein, 800 aa, Homo sapiens
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 268 - protein, 372 aa, Homo sapiens
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 269 - protein, 106 aa, Homo sapiens [sequence omitted]

SEQ ID NO: 270 - protein, 822 aa, Homo sapiens [sequence omitted]

SEQ ID NO: 271 - protein, 1076 aa, Homo sapiens [sequence omitted]

SEQ ID NO: 272 - protein, 156 aa, Homo sapiens
MGPGLRLVTGGGCRRGPREGGAGARREATPTAAPGGARPAAAGRGGAAAAAAPGHHRSLRGDVTAAGPPAPGAGWWRERLSQTWSAPPAGCLRQRRLSKGCWRWSCGALTIPEQNTLTSLPPQGRWLDSEQLPSVKGPVFTGSGWYLALSLEWQLC

SEQ ID NO: 273 - DNA, 3271 bp, Homo sapiens; identical to SEQ ID NO: 124

SEQ ID NO: 274 - DNA, 1709 bp, Homo sapiens; identical to SEQ ID NO: 1

SEQ ID NO: 275 - DNA, 1373 bp, Homo sapiens
gaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaatt

SEQ ID NO: 276 - DNA, 3442 bp, Homo sapiens; identical to SEQ ID NO: 3

SEQ ID NO: 277 - DNA, 5186 bp, Homo sapiens; identical to SEQ ID NO: 72

SEQ ID NO: 278 - DNA, 2788 bp, Homo sapiens; identical to SEQ ID NO: 6

SEQ ID NO: 279 - DNA, 3485 bp, Homo sapiens; identical to SEQ ID NO: 129

SEQ ID NO: 280 - DNA, 2386 bp, Homo sapiens; identical to SEQ ID NO: 130

SEQ ID NO: 281 - DNA, 4126 bp, Homo sapiens; identical to SEQ ID NO: 131

SEQ ID NO: 282 - DNA, 2034 bp, Homo sapiens; identical to SEQ ID NO: 78

SEQ ID NO: 283 - DNA, 911 bp, Homo sapiens; identical to SEQ ID NO: 7

SEQ ID NO: 284 - DNA, 3537 bp, Homo sapiens; identical to SEQ ID NO: 132

SEQ ID NO: 285 - DNA, 1631 bp, Homo sapiens; identical to SEQ ID NO: 80

SEQ ID NO: 286 - DNA, 2717 bp, Homo sapiens; identical to SEQ ID NO: 135

SEQ ID NO: 287 - DNA, 3203 bp, Homo sapiens; identical to SEQ ID NO: 134

SEQ ID NO: 288 - DNA, 3457 bp, Homo sapiens; identical to SEQ ID NO: 84

SEQ ID NO: 289 - DNA, 4889 bp, Homo sapiens; identical to SEQ ID NO: 86

SEQ ID NO: 290 - DNA, 933 bp, Homo sapiens; identical to SEQ ID NO: 11

SEQ ID NO: 291 - DNA, 4049 bp, Homo sapiens; identical to SEQ ID NO: 88

SEQ ID NO: 292 - DNA, 923 bp, Homo sapiens; identical to SEQ ID NO: 140

SEQ ID NO: 293 - DNA, 3234 bp, Homo sapiens; identical to SEQ ID NO: 13

SEQ ID NO: 294 - DNA, 4271 bp, Homo sapiens; identical to SEQ ID NO: 101

SEQ ID NO: 295 - DNA, 3971 bp, Homo sapiens; identical to SEQ ID NO: 155

SEQ ID NO: 296 - DNA, 4559 bp, Homo sapiens; identical to SEQ ID NO: 157

SEQ ID NO: 297 - DNA, 1851 bp, Homo sapiens; identical to SEQ ID NO: 158
  modified_base (1180): a, c, g, t, unknown, or other
  modified_base (1218): a, c, g, t, unknown, or other
  modified_base (1221): a, c, g, t, unknown, or other

SEQ ID NO: 298 - DNA, 4975 bp, Homo sapiens; identical to SEQ ID NO: 161

SEQ ID NO: 299 - DNA, 5431 bp, Homo sapiens; identical to SEQ ID NO: 109

SEQ ID NO: 300 - DNA, 1417 bp, Homo sapiens; identical to SEQ ID NO: 163

SEQ ID NO: 301 - DNA, 3516 bp, Homo sapiens
tcgagggtgcgatggcgcggacgcgggaccgcgtacgcctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgaggttctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaagcgtttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacgctagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaagga

SEQ ID NO: 302 - DNA, 2336 bp, Homo sapiens; identical to SEQ ID NO: 112

SEQ ID NO: 303 - DNA, 2341 bp, Homo sapiens; identical to SEQ ID NO: 116

SEQ ID NO: 304 - DNA, 1444 bp, Homo sapiens; identical to SEQ ID NO: 170

SEQ ID NO: 305 - DNA, 3685 bp, Homo sapiens; identical to SEQ ID NO: 117

SEQ ID NO: 306 - DNA, 822 bp, Homo sapiens; identical to SEQ ID NO: 119

SEQ ID NO: 307 - protein, 795 aa, Homo sapiens; identical to SEQ ID NO: 173

SEQ ID NO: 308 - protein, 357 aa, Homo sapiens; identical to SEQ ID NO: 39

SEQ ID NO: 309 - protein, 797 aa, Homo sapiens; identical to SEQ ID NO: 174

SEQ ID NO: 310 - protein, 1045 aa, Homo sapiens; identical to SEQ ID NO: 41

SEQ ID NO: 311 - protein, 177 aa, Homo sapiens; identical to SEQ ID NO: 176

SEQ ID NO: 312 - protein, 901 aa, Homo sapiens; identical to SEQ ID NO: 227

SEQ ID NO: 313 - protein, 747 aa, Homo sapiens; identical to SEQ ID NO: 229

SEQ ID NO: 314 - protein, 270 aa, Homo sapiens; identical to SEQ ID NO: 177

SEQ ID NO: 315 - protein, 309 aa, Homo sapiens
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 316 - protein, 707 aa, Homo sapiens; identical to SEQ ID NO: 235

SEQ ID NO: 317 - protein, 120 aa, Homo sapiens; identical to SEQ ID NO: 239

SEQ ID NO: 318 - protein, 233 aa, Homo sapiens; identical to SEQ ID NO: 182

SEQ ID NO: 319 - protein, 798 aa, Homo sapiens; identical to SEQ ID NO: 241

SEQ ID NO: 320 - protein, 170 aa, Homo sapiens; identical to SEQ ID NO: 185

SEQ ID NO: 321 - protein, 551 aa, Homo sapiens; identical to SEQ ID NO: 49

SEQ ID NO: 322 - protein, 1437 aa, Homo sapiens; identical to SEQ ID NO: 187

SEQ ID NO: 323 - protein, 235 aa, Homo sapiens; identical to SEQ ID NO: 191

SEQ ID NO: 324 - protein, 727 aa, Homo sapiens; identical to SEQ ID NO: 197

SEQ ID NO: 325 - protein, 1342 aa, Homo sapiens; identical to SEQ ID NO: 198

SEQ ID NO: 326 - protein, 894 aa, Homo sapiens; identical to SEQ ID NO: 199

SEQ ID NO: 327 - protein, 326 aa, Homo sapiens; identical to SEQ ID NO: 203

SEQ ID NO: 328 - protein, 833 aa, Homo sapiens; identical to SEQ ID NO: 205

SEQ ID NO: 329 - protein, 229 aa, Homo sapiens [sequence omitted]

SEQ ID NO: 330 - protein, 860 aa, Homo sapiens; identical to SEQ ID NO: 60

SEQ ID NO: 331 - protein, 1172 aa, Homo sapiens; identical to SEQ ID NO: 262

SEQ ID NO: 332 - protein, 754 aa, Homo sapiens; identical to SEQ ID NO: 212

SEQ ID NO: 333 - protein, 396 aa, Homo sapiens; identical to SEQ ID NO: 213

SEQ ID NO: 334 - protein, 310 aa, Homo sapiens; identical to SEQ ID NO: 62

SEQ ID NO: 335 - protein, 206 aa, Homo sapiens; identical to SEQ ID NO: 265

SEQ ID NO: 336 - protein, 372 aa, Homo sapiens; identical to SEQ ID NO: 268

SEQ ID NO: 337 - protein, 822 aa, Homo sapiens [sequence omitted]

SEQ ID NO: 338 - protein, 1117 aa, Homo sapiens
MARTRDRVRLLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCEVLHGSGCREAQHDSYVGLGPAAIALMILAFLLLLLVPLLLLMCHCGKGAKAFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 339 - protein, 156 aa, Homo sapiens; identical to SEQ ID NO: 272

SEQ ID NO: 340 - protein, 282 aa, Homo sapiens; identical to SEQ ID NO: 223

SEQ ID NO: 341 - DNA, 20 bp, Artificial Sequence
  Description of Artificial Sequence: Synthetic primer
ccgctctaatgtctgcatca

SEQ ID NO: 342 - DNA, 20 bp, Artificial Sequence
  Description of Artificial Sequence: Synthetic primer
tcgagctccccagttaaaga

SEQ ID NO: 343 - DNA, 20 bp, Artificial Sequence
  Description of Artificial Sequence: Synthetic primer
cttccaggacatgggcttta

SEQ ID NO: 344 - DNA, 20 bp, Artificial Sequence
  Description of Artificial Sequence: Synthetic primer
tgaccaacgtgttcgtgact

SEQ ID NO: 345 - DNA, 20 bp, Artificial Sequence
  Description of Artificial Sequence: Synthetic primer
tagcgacattcaagctgtgc

SEQ ID NO: 346 - DNA, 20 bp, Artificial Sequence
  Description of Artificial Sequence: Synthetic primer
ggagcagccaccatatccta

SEQ ID NO: 347 - DNA, 20 bp, Artificial Sequence
  Description of Artificial Sequence: Synthetic primer
gatttccaacgtgcaaaggt

SEQ ID NO: 348 - DNA, 20 bp, Artificial Sequence
  Description of Artificial Sequence: Synthetic primer
cgatgtgcagagcatcaact

SEQ ID NO: 349 - DNA, 20 bp, Artificial Sequence
  Description of Artificial Sequence: Synthetic primer
aggagggaagaggttttgga

SEQ ID NO: 350 - DNA, 18 bp, Artificial Sequence
  Description of Artificial Sequence: Synthetic primer
cggggactacagcacgac

SEQ ID NO: 351 - DNA, 20 bp, Artificial Sequence
  Description of Artificial Sequence: Synthetic primer
gaggagatgtggctctaccg

SEQ ID NO: 352 - DNA, 20 bp, Artificial Sequence
  Description of Artificial Sequence: Synthetic primer
caggctacggagagaactgg

SEQ ID NO: 353 - DNA, 20 bp, Artificial Sequence
  Description of Artificial Sequence: Synthetic primer
tctggtcccttgcagctagt

SEQ ID NO: 354 - DNA, 20 bp, Artificial Sequence
  Description of Artificial Sequence: Synthetic primer
caaggaggaacagagccaag

SEQ ID NO: 355 - DNA, 20 bp, Artificial Sequence
  Description of Artificial Sequence: Synthetic primer
ggtgcccgagaatatcatgt

SEQ ID NO: 356 - DNA, 20 bp, Artificial Sequence
  Description of Artificial Sequence: Synthetic primer
cagaatgctacaggggatgg

SEQ ID NO: 357 - DNA, 20 bp, Artificial Sequence
  Description of Artificial Sequence: Synthetic primer
atgaaaacccttgtggcttg

SEQ ID NO: 358 - DNA, 20 bp, Artificial Sequence
  Description of Artificial Sequence: Synthetic primer
cccactaatttccagccatc

SEQ ID NO: 359 - DNA, 20 bp, Artificial Sequence
  Description of Artificial Sequence: Synthetic primer
atcatgagacagcccacaac

SEQ ID NO: 360 - DNA, 20 bp, Artificial Sequence
  Description of Artificial Sequence: Synthetic primer
tcatgaccaacaaaggcaat

SEQ ID NO: 361 - DNA, 22 bp, Artificial Sequence
  Description of Artificial Sequence: Synthetic primer
gcagcttcttctgtgtctcttt

SEQ ID NO: 362 - DNA, 20 bp, Artificial Sequence
  Description of Artificial Sequence: Synthetic primer
gctgggcttgctttattctt

SEQ ID NO: 363 - DNA, 20 bp, Artificial Sequence
  Description of Artificial Sequence: Synthetic primer
cattgctcctccaacagaga

SEQ ID NO: 364 - DNA, 20 bp, Artificial Sequence
  Description of Artificial Sequence: Synthetic primer
tccatggcattcttgtcttc

SEQ ID NO: 365 - DNA, 20 bp, Artificial Sequence
  Description of Artificial Sequence: Synthetic primer
accgaacacgtaatgctgag

SEQ ID NO: 366 - DNA, 20 bp, Artificial Sequence
  Description of Artificial Sequence: Synthetic primer
ggagagcacagcagatgaga

SEQ ID NO: 367 - DNA, 20 bp, Artificial Sequence
  Description of Artificial Sequence: Synthetic primer
ttctgggtgagttccgtgta

SEQ ID NO: 368 - DNA, 21 bp, Artificial Sequence
  Description of Artificial Sequence: Synthetic primer
ctccgaacacttcagcataca

SEQ ID NO: 369 - DNA, 20 bp, Artificial Sequence
  Description of Artificial Sequence: Synthetic primer
ggcccagataaaggtcatgt

SEQ ID NO: 370 - DNA, 20 bp, Artificial Sequence
  Description of Artificial Sequence: Synthetic primer
gagtcatggattccaccaga

SEQ ID NO: 371 - DNA, 20 bp, Artificial Sequence
  Description of Artificial Sequence: Synthetic primer
ccacgttaggagcaaccttt

SEQ ID NO: 372 - DNA, 21 bp, Artificial Sequence
  Description of Artificial Sequence: Synthetic primer
ggcctgcagtactcaactgac

SEQ ID NO: 373 - DNA, 23 bp, Artificial Sequence
  Description of Artificial Sequence: Synthetic primer
tctcctctttcatatcctccaag

SEQ ID NO: 374 - DNA, 20 bp, Artificial Sequence
  Description of Artificial Sequence: Synthetic primer
caaatcagtgccctcagaga

SEQ ID NO: 375 - DNA, 23 bp, Artificial Sequence
  Description of Artificial Sequence: Synthetic primer
ttcacagacacgtaccacagtct

SEQ ID NO: 376 - DNA, 20 bp, Artificial Sequence
  Description of Artificial Sequence: Synthetic primer
aggaagtgggtgaccttcat

SEQ ID NO: 377 - DNA, 21 bp, Artificial Sequence
  Description of Artificial Sequence: Synthetic primer
ctgtcaaccatgcagagtgaa

SEQ ID NO: 378 - DNA, 20 bp, Artificial Sequence
  Description of Artificial Sequence: Synthetic primer
atgggcaggaaatgagagag

SEQ ID NO: 379 - DNA, 20 bp, Artificial Sequence
  Description of Artificial Sequence: Synthetic primer
caccacccaagatcctctct

SEQ ID NO: 380 - DNA, 22 bp, Artificial Sequence
  Description of Artificial Sequence: Synthetic primer
cgatacagcgaaggagtctaac

SEQ ID NO: 381 - DNA, 21 bp, Artificial Sequence
  Description of Artificial Sequence: Synthetic primer
tgacacagcttatgccctatg

SEQ ID NO: 382 - DNA, 20 bp, Artificial Sequence
  Description of Artificial Sequence: Synthetic primer
tgcatccacagagtgctttc

SEQ ID NO: 383 - DNA, 21 bp, Artificial Sequence
  Description of Artificial Sequence: Synthetic primer
ttgagggttccgagtctgtag

SEQ ID NO: 384 - DNA, 20 bp, Artificial Sequence
  Description of Artificial Sequence: Synthetic primer
acacagtcggtggcctatta

SEQ ID NO: 385 - DNA, 20 bp, Artificial Sequence
  Description of Artificial Sequence: Synthetic primer
ccagtgcgtatggagaaatg

SEQ ID NO: 386 - DNA, 20 bp, Artificial Sequence
  Description of Artificial Sequence: Synthetic primer
tttcctcctccctcctcttc

SEQ ID NO: 387 - DNA, 20 bp, Artificial Sequence
  Description of Artificial Sequence: Synthetic primer
ctactgcggcaatcagatgt

SEQ ID NO: 388 - DNA, 20 bp, Artificial Sequence
  Description of Artificial Sequence: Synthetic primer
ggtggaagggccaaatataa

SEQ ID NO: 389 - DNA, 20 bp, Artificial Sequence
  Description of Artificial Sequence: Synthetic primer
gccaatgcatagaatccaaa

SEQ ID NO: 390 - DNA, 20 bp, Artificial Sequence
  Description of Artificial Sequence: Synthetic primer
gagacacagagacgcacaca

SEQ ID NO: 391 - DNA, 20 bp, Artificial Sequence
  Description of Artificial Sequence: Synthetic primer
ttggaggtaaccacgtttca

SEQ ID NO: 392 - DNA, 20 bp, Artificial Sequence
  Description of Artificial Sequence: Synthetic primer
tctggctgtggaagtcactc

SEQ ID NO: 393 - DNA, 20 bp, Artificial Sequence
  Description of Artificial Sequence: Synthetic primer
catcttgtaccacggcaatg

SEQ ID NO: 394 - DNA, 20 bp, Artificial Sequence
  Description of Artificial Sequence: Synthetic primer
gaattcaaccagggcagagt

SEQ ID NO: 395 - DNA, 20 bp, Artificial Sequence
  Description of Artificial Sequence: Synthetic primer
aacggacagctttggatttc

SEQ ID NO: 396 - DNA, 20 bp, Artificial Sequence
  Description of Artificial Sequence: Synthetic primer
tggaggcgtagtggtaacag

SEQ ID NO: 397 - DNA, 20 bp, Artificial Sequence
  Description of Artificial Sequence: Synthetic primer
ggtggtatcatctgcctgtg

SEQ ID NO: 398 - DNA, 20 bp, Artificial Sequence
  Description of Artificial Sequence: Synthetic primer
caggcagcagaagagttcag

SEQ ID NO: 399 - DNA, 20 bp, Artificial Sequence
  Description of Artificial Sequence: Synthetic primer
atggcagagcagaacatcag

SEQ ID NO: 400 - DNA, 20 bp, Artificial Sequence
  Description of Artificial Sequence: Synthetic primer
ggaaagatctggctccaatg

SEQ ID NO: 401 - DNA, 21 bp, Artificial Sequence
  Description of Artificial Sequence: Synthetic primer
gccctacatctaagccagaga

SEQ ID NO: 402 - DNA, 21 bp, Artificial Sequence
  Description of Artificial Sequence: Synthetic primer
gtcatagccgacatcctcttc

SEQ ID NO: 403 - DNA, 20 bp, Artificial Sequence
  Description of Artificial Sequence: Synthetic primer
gggacgaactggttccatag

SEQ ID NO: 404 - DNA, 20 bp, Artificial Sequence
  Description of Artificial Sequence: Synthetic primer
ttgggtcaaattgctgaaga

SEQ ID NO: 405 - DNA, 20 bp, Artificial Sequence
  Description of Artificial Sequence: Synthetic primer
caaataaccggtccaggagt

SEQ ID NO: 406 - DNA, 20 bp, Artificial Sequence
  Description of Artificial Sequence: Synthetic primer
acgggaggctctgaaagtaa

SEQ ID NO: 407 - DNA, 20 bp, Artificial Sequence
  Description of Artificial Sequence: Synthetic primer
agaagctgtcggccttgtag

SEQ ID NO: 408 - DNA, 22 bp, Artificial Sequence
  Description of Artificial Sequence: Synthetic primer
ttcaaggaacaccaggatagaa

SEQ ID NO: 409 - DNA, 21 bp, Artificial Sequence
  Description of Artificial Sequence: Synthetic primer
tcaccgacgagtctcaactaa

SEQ ID NO: 410 - DNA, 22 bp, Artificial Sequence
  Description of Artificial Sequence: Synthetic primer
actcccttcaaaggaatgaatc

SEQ ID NO: 411 - DNA, 18 bp, Artificial Sequence
  Description of Artificial Sequence: Synthetic primer
cagcagctgcagccagac

SEQ ID NO: 412 - DNA, 21 bp, Artificial Sequence
  Description of Artificial Sequence: Synthetic primer
cttatctgtggaccctgatgc

SEQ ID NO: 413 - DNA, 20 bp, Artificial Sequence
  Description of Artificial Sequence: Synthetic primer
ggctatctggagcaggaaag

SEQ ID NO: 414 - DNA, 20 bp, Artificial Sequence
  Description of Artificial Sequence: Synthetic primer
atcattcatccaggcctctc

SEQ ID NO: 415 - DNA, 20 bp, Artificial Sequence
  Description of Artificial Sequence: Synthetic primer
gggatgagatcactgggtct

SEQ ID NO: 416 - DNA, 21 bp, Artificial Sequence
  Description of Artificial Sequence: Synthetic primer
cccaacaactacaacgcctac

SEQ ID NO: 417 - DNA, 20 bp, Artificial Sequence
  Description of Artificial Sequence: Synthetic primer
tcgagacgaccagcactatc

SEQ ID NO: 418 - DNA, 20 bp, Artificial Sequence
  Description of Artificial Sequence: Synthetic primer
ctggagggattccactcatt

SEQ ID NO: 419 - DNA, 20 bp, Artificial Sequence
  Description of Artificial Sequence: Synthetic primer
aaggacatcagccaggagat

SEQ ID NO: 420 - DNA, 20 bp, Artificial Sequence
  Description of Artificial Sequence: Synthetic primer
ctggcatggacacagacttc

SEQ ID NO: 421 - DNA, 20 bp, Artificial Sequence
  Description of Artificial Sequence: Synthetic primer
atccctagcacgacaccttc

SEQ ID NO: 422 - DNA, 20 bp, Artificial Sequence
  Description of Artificial Sequence: Synthetic primer
agatgtggctctaccggaac

SEQ ID NO: 423 - DNA, 20 bp, Artificial Sequence
  Description of Artificial Sequence: Synthetic primer
gaagacctgtgtgcagcatt

SEQ ID NO: 424 - DNA, 20 bp, Artificial Sequence
  Description of Artificial Sequence: Synthetic primer
tgccatcacagtgggaatac

SEQ ID NO: 425 - DNA, 20 bp, Artificial Sequence
  Description of Artificial Sequence: Synthetic primer
gcacaactttccttgcagtg

SEQ ID NO: 426 - DNA, 20 bp, Artificial Sequence
  Description of Artificial Sequence: Synthetic primer
acaggggagacagagcaaga

SEQ ID NO: 427 - DNA, 20 bp, Artificial Sequence
  Description of Artificial Sequence: Synthetic primer
ggagctccagggttcataag

SEQ ID NO: 428 - DNA, 20 bp, Artificial Sequence
  Description of Artificial Sequence: Synthetic primer
cagccaggccttatgaaagt

SEQ ID NO: 429 - DNA, 20 bp, Artificial Sequence
  Description of Artificial Sequence: Synthetic primer
tgcctcccgtgtgttattta

SEQ ID NO: 430 - DNA, 20 bp, Artificial Sequence
  Description of Artificial Sequence: Synthetic primer
ataacctggagccctctcac

SEQ ID NO: 431 - DNA, 20 bp, Artificial Sequence
  Description of Artificial Sequence: Synthetic primer
gccaagttgtggtcttcaaa

SEQ ID NO: 432 - DNA, 20 bp, Artificial Sequence
  Description of Artificial Sequence: Synthetic primer
cggtaggagggaagaggttt

SEQ ID NO: 433 - DNA, 20 bp, Artificial Sequence
  Description of Artificial Sequence: Synthetic primer
ggctcagagtggtggtttct

SEQ ID NO: 434 - DNA, 20 bp, Artificial Sequence
  Description of Artificial Sequence: Synthetic primer
ctggctgcagaagaactcaa

SEQ ID NO: 435 - DNA, 21 bp, Artificial Sequence
  Description of Artificial Sequence: Synthetic primer
cccagcacaaaggagatagtt

SEQ ID NO: 436 - DNA, 20 bp, Artificial Sequence
  Description of Artificial Sequence: Synthetic primer
gagggcctttctggttctct

SEQ ID NO: 437 - DNA, 20 bp, Artificial Sequence
  Description of Artificial Sequence: Synthetic primer
catcactctggcctcatcac

SEQ ID NO: 438 - DNA, 20 bp, Artificial Sequence
  Description of Artificial Sequence: Synthetic primer
gtctgtgatcaaatgcgtga

SEQ ID NO: 439 - DNA, 25 bp, Artificial Sequence
  Description of Artificial Sequence: Synthetic primer
ctcagccagtaattcttcatactgt

SEQ ID NO: 440 - DNA, 20 bp, Artificial Sequence
  Description of Artificial Sequence: Synthetic primer
tcttcaccagttctgccaag

SEQ ID NO: 441 - DNA, 20 bp, Artificial Sequence
  Description of Artificial Sequence: Synthetic primer
gctgcttgttctgtggtgtt

SEQ ID NO: 442 - DNA, 20 bp, Artificial Sequence
  Description of Artificial Sequence: Synthetic primer
ggcagtgatctcccagattt

SEQ ID NO: 443 - DNA, 20 bp, Artificial Sequence
  Description of Artificial Sequence: Synthetic primer
ctcctgctctctggcttctt

SEQ ID NO: 444 - DNA, 21 bp, Artificial Sequence
  Description of Artificial Sequence: Synthetic primer
tcattgtcaggttgctttctg

SEQ ID NO: 445 - DNA, 20 bp, Artificial Sequence
  Description of Artificial Sequence: Synthetic primer
tggaacacccgtttaacaaa

SEQ ID NO: 446 - DNA, 20 bp, Artificial Sequence
  Description of Artificial Sequence: Synthetic primer
gcacaactttccttgcagtg

SEQ ID NO: 447 - DNA, 20 bp, Artificial Sequence
  Description of Artificial Sequence: Synthetic primer
tccctagacggacattgagg

SEQ ID NO: 448 - DNA, 20 bp, Artificial Sequence
  Description of Artificial Sequence: Synthetic primer
ctcgcaagaaccatctgaca

SEQ ID NO: 449 - DNA, 21 bp, Artificial Sequence
  Description of Artificial Sequence: Synthetic primer
aggcagagctgagctacagag

SEQ ID NO: 450 - DNA, 20 bp, Artificial Sequence
  Description of Artificial Sequence: Synthetic primer
gtgcttgtttggagcaatga

SEQ ID NO: 451 - DNA, 20 bp, Artificial Sequence
  Description of Artificial Sequence: Synthetic primer
acaccaagatcgacagcatc

SEQ ID NO: 452 - DNA, 20 bp, Artificial Sequence
  Description of Artificial Sequence: Synthetic primer
catctgcacgctgttgtatg

SEQ ID NO: 453 - DNA, 20 bp, Artificial Sequence
  Description of Artificial Sequence: Synthetic primer
tcctggtgaacaagctcaag

SEQ ID NO: 454 - DNA, 20 bp, Artificial Sequence
  Description of Artificial Sequence: Synthetic primer
ccaccaggcttcaggagtag

SEQ ID NO: 455 - DNA, 20 bp, Artificial Sequence
  Description of Artificial Sequence: Synthetic primer
ccactgcagctaccgtagaa

SEQ ID NO: 456 - DNA, 21 bp, Artificial Sequence
  Description of Artificial Sequence: Synthetic primer
ggtgaagacgattctggagag

SEQ ID NO: 457 - DNA, 20 bp, Artificial Sequence
  Description of Artificial Sequence: Synthetic primer
acttggttaagggaggctga

SEQ ID NO: 458 - DNA, 20 bp, Artificial Sequence
  Description of Artificial Sequence: Synthetic primer
agaaaggaccaaatgccaaa

SEQ ID NO: 459 - DNA, 23 bp, Artificial Sequence
  Description of Artificial Sequence: Synthetic primer
agctgagaccttaggaaggaaat

SEQ ID NO: 460 - DNA, 20 bp, Artificial Sequence
  Description of Artificial Sequence: Synthetic primer
actgttgccatcattgcttc

SEQ ID NO: 461 - DNA, 21 bp, Artificial Sequence
  Description of Artificial Sequence: Synthetic primer
gagaagcacgaggagttctgt

SEQ ID NO: 462 - DNA, 22 bp, Artificial Sequence
  Description of Artificial Sequence: Synthetic primer
gatgactgaacttcctccagaa

SEQ ID NO: 463 - DNA, 20 bp, Artificial Sequence
  Description of Artificial Sequence: Synthetic primer
taggaaggagccacagcatt

SEQ ID NO: 464 - DNA, 20 bp, Artificial Sequence
  Description of Artificial Sequence: Synthetic primer
gaacaggcatgcaagtgaga

SEQ ID NO: 465 - DNA, 20 bp, Artificial Sequence
  Description of Artificial Sequence: Synthetic primer
tctctaagccgctttcatca

SEQ ID NO: 466 - DNA, 25 bp, Artificial Sequence
  Description of Artificial Sequence: Synthetic primer
actgaaatacacagcagtcaacagt

SEQ ID NO: 467 - DNA, 20 bp, Artificial Sequence
  Description of Artificial Sequence: Synthetic primer
ctagcctttggtccacatca

SEQ ID NO: 468 - DNA, 20 bp, Artificial Sequence
  Description of Artificial Sequence: Synthetic primer
cgcttcctgaagtagcgatt

SEQ ID NO: 469 - DNA, 20 bp, Artificial Sequence
  Description of Artificial Sequence: Synthetic primer
ggccctgtaggctgtgttat

SEQ ID NO: 470 - DNA, 22 bp, Artificial Sequence
  Description of Artificial Sequence: Synthetic primer
cctgacagctcattgtcatgta

SEQ ID NO: 471 - DNA, 20 bp, Artificial Sequence
  Description of Artificial Sequence: Synthetic primer
gatccttcttcaccgcctac

SEQ ID NO: 472 - DNA, 20 bp, Artificial Sequence
  Description of Artificial Sequence: Synthetic primer
gcccagatattggctgtgta

SEQ ID NO: 473 - DNA, 20 bp, Artificial Sequence
  Description of Artificial Sequence: Synthetic primer
tttggagcctgtcttgtttg

SEQ ID NO: 474 - DNA, 20 bp, Artificial Sequence
  Description of Artificial Sequence: Synthetic primer
gtgtccgtgggtcaactttt

SEQ ID NO: 475 - DNA, 20 bp, Artificial Sequence
  Description of Artificial Sequence: Synthetic primer
atagatgtgaagcccaagcc

SEQ ID NO: 476 - DNA, 20 bp, Artificial Sequence
  Description of Artificial Sequence: Synthetic primer
ttaaccgtctccttggttcc

SEQ ID NO: 477 - DNA, 20 bp, Artificial Sequence
  Description of Artificial Sequence: Synthetic primer
tctccaagcggaaagaaaga

SEQ ID NO: 478 - DNA, 20 bp, Artificial Sequence
  Description of Artificial Sequence: Synthetic primer
ccacatctgtgcatgacctc

SEQ ID NO: 479 - DNA, 20 bp, Artificial Sequence
  Description of Artificial Sequence: Synthetic primer
cttcgtgaacaccagcagat

SEQ ID NO: 480 - DNA, 20 bp, Artificial Sequence
  Description of Artificial Sequence: Synthetic primer
cagtggtgccttacatggtg

SEQ ID NO: 481 - DNA, 20 bp, Artificial Sequence
  Description of Artificial Sequence: Synthetic primer
aaaagaatccaggagcgaga

SEQ ID NO: 482 - DNA, 20 bp, Artificial Sequence
  Description of Artificial Sequence: Synthetic primer
aacttattgggttggcgaag

SEQ ID NO: 483 - DNA, 20 bp, Artificial Sequence
  Description of Artificial Sequence: Synthetic primer
cagattttggctggtctgtg

SEQ ID NO: 484 - DNA, 20 bp, Artificial Sequence
  Description of Artificial Sequence: Synthetic primer
aaactgctcaggcataaccc

SEQ ID NO: 485 - DNA, 20 bp, Artificial Sequence
  Description of Artificial Sequence: Synthetic primer
aggaccaggtgtttgtcctg

SEQ ID NO: 486 - DNA, 21 bp, Artificial Sequence
  Description of Artificial Sequence: Synthetic primer
ttgactgttccaccacttgtc

SEQ ID NO: 487 - DNA, 20 bp, Artificial Sequence
  Description of Artificial Sequence: Synthetic primer
gtgccggaagtcatactcac

SEQ ID NO: 488 - DNA, 20 bp, Artificial Sequence
  Description of Artificial Sequence: Synthetic primer
ccaaagatgtctctgcctga

SEQ ID NO: 489 - DNA, 20 bp, Artificial Sequence
  Description of Artificial Sequence: Synthetic primer
cagaaggatgtcccatctga

SEQ ID NO: 490 - DNA, 20 bp, Artificial Sequence
  Description of Artificial Sequence: Synthetic primer
ggcctcagtcctgttctctt

SEQ ID NO: 491 - DNA, 20 bp, Artificial Sequence
  Description of Artificial Sequence: Synthetic primer
cagactgcgacacctgagac

SEQ ID NO: 492 - DNA, 21 bp, Artificial Sequence
  Description of Artificial Sequence: Synthetic primer
ttgcaagagtcctgaatctga

SEQ ID NO: 493 - DNA, 20 bp, Artificial Sequence
  Description of Artificial Sequence: Synthetic primer
gccgatacagctcgagaata

SEQ ID NO: 494 - DNA, 20 bp, Artificial Sequence
  Description of Artificial Sequence: Synthetic primer
gggagactcctgtcgtctgt

SEQ ID NO: 495 - DNA, 21 bp, Artificial Sequence
  Description of Artificial Sequence: Synthetic primer
ggagatctgcagagggtagag

SEQ ID NO: 496 - DNA, 20 bp, Artificial Sequence
  Description of Artificial Sequence: Synthetic primer
ccggccattatcagaatgtt

SEQ ID NO: 497 - DNA, 20 bp, Artificial Sequence
  Description of Artificial Sequence: Synthetic primer
tcctggaagttgagtggatg

SEQ ID NO: 498 - DNA, 20 bp, Artificial Sequence
  Description of Artificial Sequence: Synthetic primer
agttgttacccgtgggaagt

SEQ ID NO: 499 - DNA, 20 bp, Artificial Sequence
  Description of Artificial Sequence: Synthetic primer
gacaccggctcatggtagta

SEQ ID NO: 500 - DNA, 20 bp, Artificial Sequence
  Description of Artificial Sequence: Synthetic primer
catcactctggcctcatcac

SEQ ID NO: 501 - DNA, 24 bp, Artificial Sequence
  Description of Artificial Sequence: Synthetic primer
tgaaccagtagaatcttcagcaag

SEQ ID NO: 502 - DNA, 20 bp, Artificial Sequence
  Description of Artificial Sequence: Synthetic primer
ttctcccgtagttgggaaag

SEQ ID NO: 503 - DNA, 20 bp, Artificial Sequence
  Description of Artificial Sequence: Synthetic primer
agaggccatctttggatctc

SEQ ID NO: 504 - DNA, 20 bp, Artificial Sequence
  Description of Artificial Sequence: Synthetic primer
atttcgaggttggccttaga

SEQ ID NO: 505 - DNA, 20 bp, Artificial Sequence
  Description of Artificial Sequence: Synthetic primer
atgccatgctcccttaccta

SEQ ID NO: 506 - DNA, 19 bp, Artificial Sequence
  Description of Artificial Sequence: Synthetic primer
attttgtgaagcggcgaag

SEQ ID NO: 507 - DNA, 20 bp, Artificial Sequence
  Description of Artificial Sequence: Synthetic primer
ctagggtcttggtggctttg

SEQ ID NO: 508 - DNA, 22 bp, Artificial Sequence
  Description of Artificial Sequence: Synthetic primer
tgccctatagctgtcagtgtgt

SEQ ID NO: 509 - DNA, 20 bp, Artificial Sequence
  Description of Artificial Sequence: Synthetic primer
agcctgtcttgttgctgttg

SEQ ID NO: 510 - DNA, 20 bp, Artificial Sequence
  Description of Artificial Sequence: Synthetic primer
aaggacacttataggctttt

SEQ ID NO: 511 - DNA, 22 bp, Artificial Sequence
  Description of Artificial Sequence: Synthetic primer
cgtgtaggtgggttttttttta

SEQ ID NO: 512 - DNA, 20 bp, Artificial Sequence
  Description of Artificial Sequence: Synthetic primer
tgtgatcgcactgacacggc

SEQ ID NO: 513 - DNA, 20 bp, Artificial Sequence
  Description of Artificial Sequence: Synthetic primer
ggtaccacaaactgtgattc

SEQ ID NO: 514 - DNA, 20 bp, Artificial Sequence
  Description of Artificial Sequence: Synthetic primer
ccgagaatatcatgtccagt

SEQ ID NO: 515 - DNA, 20 bp, Artificial Sequence
  Description of Artificial Sequence: Synthetic primer
tgcggcagcaaggaaatcct

SEQ ID NO: 516 - DNA, 24 bp, Artificial Sequence
  Description of Artificial Sequence: Synthetic primer
cctcaactgatgtagaaatgacta

SEQ ID NO: 517 - DNA, 20 bp, Artificial Sequence
  Description of Artificial Sequence: Synthetic primer
agatatccacaaagcaagta

SEQ ID NO: 518 - DNA, 20 bp, Artificial Sequence
  Description of Artificial Sequence: Synthetic primer
gtggccagcagagatctgca

SEQ ID NO: 519 - DNA, 20 bp, Artificial Sequence
  Description of Artificial Sequence: Synthetic primer
acaaagagactataccctga

SEQ ID NO: 520 - DNA, 20 bp, Artificial Sequence
  Description of Artificial Sequence: Synthetic primer
gaagagacgaaagatcaaaa

SEQ ID NO: 521 - DNA, 20 bp, Artificial Sequence
  Description of Artificial Sequence: Synthetic primer
ttgcttttttcacttaaata

SEQ ID NO: 522 - DNA, 20 bp, Artificial Sequence
  Description of Artificial Sequence: Synthetic primer
taaggcataggaggtggtat

SEQ ID NO: 523 - DNA, 20 bp, Artificial Sequence
  Description of Artificial Sequence: Synthetic primer
atcacagagagcaaatagtc

SEQ ID NO: 524 - DNA, 20 bp, Artificial Sequence
  Description of Artificial Sequence: Synthetic primer
atgatctctgcatcagggta

SEQ ID NO: 525 - DNA, 20 bp, Artificial Sequence
  Description of Artificial Sequence: Synthetic primer
cctggaaacgttttgcagct

SEQ ID NO: 526 - DNA, 20 bp, Artificial Sequence
  Description of Artificial Sequence: Synthetic primer
acaattccagcagccttctg

SEQ ID NO: 527 - DNA, 22 bp, Artificial Sequence
  Description of Artificial Sequence: Synthetic primer
ggaatgattactacagatgaga

SEQ ID NO: 528 - DNA, 20 bp, Artificial Sequence
  Description of Artificial Sequence: Synthetic primer
gcccagttttacattccatg

SEQ ID NO: 529 - DNA, 21 bp, Artificial Sequence
  Description of Artificial Sequence: Synthetic primer
tgtctctgtatgctgaactag

SEQ ID NO: 530 - DNA, 20 bp, Artificial Sequence
  Description of Artificial Sequence: Synthetic primer
ggtgtagaaattataagcct

SEQ ID NO: 531 - DNA, 20 bp, Artificial Sequence
  Description of Artificial Sequence: Synthetic primer
cgaatttcagtacttgagag

SEQ ID NO: 532 - DNA, 20 bp, Artificial Sequence
  Description of Artificial Sequence: Synthetic primer
ttgctggcttgtttggttgc

SEQ ID NO: 533 - DNA, 20 bp, Artificial Sequence
  Description of Artificial Sequence: Synthetic primer
tcctcttttagtactggttc

SEQ ID NO: 534 - DNA, 20 bp, Artificial Sequence
  Description of Artificial Sequence: Synthetic primer
tctttggaatcacagtttgt

SEQ ID NO: 535 - DNA, 20 bp, Artificial Sequence
  Description of Artificial Sequence: Synthetic primer
ctggccaccatcttcagcaa

SEQ ID NO: 536 - DNA, 22 bp, Artificial Sequence
  Description of Artificial Sequence: Synthetic primer
gccttctacagttataattcag

SEQ ID NO: 537 - DNA, 20 bp, Artificial Sequence
  Description of Artificial Sequence: Synthetic primer
gaggaacagagccaagatgg

SEQ ID NO: 538 - DNA, 20 bp, Artificial Sequence
  Description of Artificial Sequence: Synthetic primer
gactgatattcttgtggaat

SEQ ID NO: 539 - DNA, 20 bp, Artificial Sequence
  Description of Artificial Sequence: Synthetic primer
aattcagttctggctattgc

SEQ ID NO: 540 - DNA, 20 bp, Artificial Sequence
  Description of Artificial Sequence: Synthetic primer
aggaacagagccaagatggg

SEQ ID NO: 541 - DNA, 20 bp, Artificial Sequence
  Description of Artificial Sequence: Synthetic primer
tcttgtggaattacctactt

SEQ ID NO: 542 - DNA, 20 bp, Artificial Sequence
  Description of Artificial Sequence: Synthetic primer
caaagaggttcagggagctg

SEQ ID NO: 543 - DNA, 20 bp, Artificial Sequence
  Description of Artificial Sequence: Synthetic primer
agcccatgtcactcataggg

SEQ ID NO: 544 - DNA, 20 bp, Artificial Sequence
  Description of Artificial Sequence: Synthetic primer
accaggtattccacctgctg

SEQ ID NO: 545 - DNA, 20 bp, Artificial Sequence
  Description of Artificial Sequence: Synthetic primer
agagtgaaggtgcccatgat

SEQ ID NO: 546 - DNA, 20 bp, Artificial Sequence
  Description of Artificial Sequence: Synthetic primer
gaggtcgatgctgagtagcc

SEQ ID NO: 547 - DNA, 20 bp, Artificial Sequence
  Description of Artificial Sequence: Synthetic primer
ctgatggacactgcaaggaa

SEQ ID NO: 548 - DNA, 20 bp, Artificial Sequence
  Description of Artificial Sequence: Synthetic primer
caaagaccccagtggtgagt

SEQ ID NO: 549 - DNA, 20 bp, Artificial Sequence
  Description of Artificial Sequence: Synthetic primer
tcgatgtgctttagccactg

SEQ ID NO: 550 - DNA, 20 bp, Artificial Sequence
  Description of Artificial Sequence: Synthetic primer
gccacagtgatgtgtgaagg

SEQ ID NO: 551 - DNA, 20 bp, Artificial Sequence
  Description of Artificial Sequence: Synthetic primer
ggcgaaggtggcttttattt

SEQ ID NO: 552 - DNA, 21 bp, Artificial Sequence
  Description of Artificial Sequence: Synthetic primer
tcaggttgctttctgaacacc

SEQ ID NO: 553 - DNA, 20 bp, Artificial Sequence
  Description of Artificial Sequence: Synthetic primer
ggtgcagttggtgaggtttt

SEQ ID NO: 554 - DNA, 20 bp, Artificial Sequence
  Description of Artificial Sequence: Synthetic primer
gctgaggccataaacagctc

SEQ ID NO: 555 - DNA, 20 bp, Artificial Sequence
  Description of Artificial Sequence: Synthetic primer
atttgtgatttggcctggag

SEQ ID NO: 556 - DNA, 20 bp, Artificial Sequence
  Description of Artificial Sequence: Synthetic primer
gtcttgccccctgacactta

SEQ ID NO: 557 - DNA, 20 bp, Artificial Sequence
  Description of Artificial Sequence: Synthetic primer
tggtggtttttaggctggac

SEQ ID NO: 558 - DNA, 20 bp, Artificial Sequence
  Description of Artificial Sequence: Synthetic primer
tcttcatgcatctgctttgg

SEQ ID NO: 559 - DNA, 20 bp, Artificial Sequence
  Description of Artificial Sequence: Synthetic primer
tgtgaaggccctcctaagtt

SEQ ID NO: 560 - DNA, 20 bp, Artificial Sequence
  Description of Artificial Sequence: Synthetic primer
gtgaccagcatggcataatc

SEQ ID NO: 561 - DNA, 20 bp, Artificial Sequence
  Description of Artificial Sequence: Synthetic primer
atgggaattcactcaccaca

SEQ ID NO: 562 - DNA, 20 bp, Artificial Sequence
  Description of Artificial Sequence: Synthetic primer
acctggtgccttagtccttg

SEQ ID NO: 563 - DNA, 21 bp, Artificial Sequence
  Description of Artificial Sequence: Synthetic primer
cacctgaaactcagcagtcac

SEQ ID NO: 564 - DNA, 20 bp, Artificial Sequence
  Description of Artificial Sequence: Synthetic primer
cagcttctgacacccgagta

SEQ ID NO: 565 - DNA, 20 bp, Artificial Sequence
  Description of Artificial Sequence: Synthetic primer
tgcttctcctcctctccatc

SEQ ID NO: 566 - DNA, 21 bp, Artificial Sequence
  Description of Artificial Sequence: Synthetic primer
ctccctgttatcaggtgcttt

SEQ ID NO: 567 - DNA, 20 bp, Artificial Sequence
  Description of Artificial Sequence: Synthetic primer
caaagttctgctccaccaac

SEQ ID NO: 568 - DNA, 20 bp, Artificial Sequence
  Description of Artificial Sequence: Synthetic primer
ctgaccggctttcatcacta

SEQ ID NO: 569 - DNA, 20 bp, Artificial Sequence
  Description of Artificial Sequence: Synthetic primer
gcagatccagtcctcctctt

SEQ ID NO: 570 - DNA, 20 bp, Artificial Sequence
  Description of Artificial Sequence: Synthetic primer
agtccaagtcccagtgtgtg

SEQ ID NO: 571 - DNA, 20 bp, Artificial Sequence
  Description of Artificial Sequence: Synthetic primer
gaagatggccgacactctct

SEQ ID NO: 572 - DNA, 20 bp, Artificial Sequence
  Description of Artificial Sequence: Synthetic primer
atgacatccaaggaagcaga

SEQ ID NO: 573 - DNA, 20 bp, Artificial Sequence
  Description of Artificial Sequence: Synthetic primer
ggagcagagctgaagcattt

SEQ ID NO: 574 - DNA, 20 bp, Artificial Sequence
  Description of Artificial Sequence: Synthetic primer
cccagttcctcaagctcaat

SEQ ID NO: 575 - DNA, 20 bp, Artificial Sequence
  Description of Artificial Sequence: Synthetic primer
tgctgatggtccagctctta

SEQ ID NO: 576 - DNA, 20 bp, Artificial Sequence
  Description of Artificial Sequence: Synthetic primer
tccacgagctgggctataat

SEQ ID NO: 577 - DNA, 20 bp, Artificial Sequence
  Description of Artificial Sequence: Synthetic primer
gtgcacgttcaaggagattc

SEQ ID NO: 578 - DNA, 20 bp, Artificial Sequence
  Description of Artificial Sequence: Synthetic primer
caccacggacaaagagattg

SEQ ID NO: 579 - DNA, 20 bp, Artificial Sequence
  Description of Artificial Sequence: Synthetic primer
caatgtgtaccgatccgaga

SEQ ID NO: 580 - DNA, 20 bp, Artificial Sequence
  Description of Artificial Sequence: Synthetic primer
agctcaggagaccagcattt

SEQ ID NO: 581 - DNA, 20 bp, Artificial Sequence
  Description of Artificial Sequence: Synthetic primer
tttcagggatgggacaactt

SEQ ID NO: 582 - DNA, 21 bp, Artificial Sequence
  Description of Artificial Sequence: Synthetic primer
gcaatctgcatacaccagttc

SEQ ID NO: 583 - DNA, 20 bp, Artificial Sequence
  Description of Artificial Sequence: Synthetic primer
tgccctcctcctaagacatc

SEQ ID NO: 584 - DNA, 20 bp, Artificial Sequence
  Description of Artificial Sequence: Synthetic primer
actccgctgacctacaacaa

SEQ ID NO: 585 - DNA, 20 bp, Artificial Sequence
  Description of Artificial Sequence: Synthetic primer
gctgcaggctaatcctttct

SEQ ID NO: 586 - DNA, 20 bp, Artificial Sequence
  Description of Artificial Sequence: Synthetic primer
gcaataaatgaatgggctga

SEQ ID NO: 587 - DNA, 20 bp, Artificial Sequence
  Description of Artificial Sequence: Synthetic primer
catccaaacatcatgcacaa

SEQ ID NO: 588 - DNA, 20 bp, Artificial Sequence
  Description of Artificial Sequence: Synthetic primer
gtgacttcagggctgatgaa

SEQ ID NO: 589 - DNA, 25 bp, Artificial Sequence
  Description of Artificial Sequence: Synthetic primer
ggtgtctatttggactctaagctct

SEQ ID NO: 590 - DNA, 20 bp, Artificial Sequence
  Description of Artificial Sequence: Synthetic primer
agctgcatatcacccaacac

SEQ ID NO: 591 - DNA, 20 bp, Artificial Sequence
  Description of Artificial Sequence: Synthetic primer
gttcccagaggcgtacctta

SEQ ID NO: 592 - DNA, 21 bp, Artificial Sequence
  Description of Artificial Sequence: Synthetic primer
tcagcatcagggagttcagtt

SEQ ID NO: 593 - DNA, 23 bp, Artificial Sequence
  Description of Artificial Sequence: Synthetic primer
ggagatcatcatctattgcacag

SEQ ID NO: 594 - DNA, 20 bp, Artificial Sequence
  Description of Artificial Sequence: Synthetic primer
tggtgtcatggaccaaagtc

SEQ ID NO: 595 - DNA, 21 bp, Artificial Sequence
  Description of Artificial Sequence: Synthetic primer
gttcacgagctctgtgctcta

SEQ ID NO: 596 - DNA, 20 bp, Artificial Sequence
  Description of Artificial Sequence: Synthetic primer
acctctttgggctggtattg

SEQ ID NO: 597 - DNA, 20 bp, Artificial Sequence
  Description of Artificial Sequence: Synthetic primer
acctgctgtggtggtttgta

SEQ ID NO: 598 - DNA, 20 bp, Artificial Sequence
  Description of Artificial Sequence: Synthetic primer
gtgcaggaggtcaatccttt

SEQ ID NO: 599 - DNA, 20 bp, Artificial Sequence
  Description of Artificial Sequence: Synthetic primer
tgggacacttgaggaagaaa

SEQ ID NO: 600 - DNA, 22 bp, Artificial Sequence
  Description of Artificial Sequence: Synthetic primer
gtgttatagttggctgggctct

SEQ ID NO: 601 - DNA, 22 bp, Artificial Sequence
  Description of Artificial Sequence: Synthetic primer
caactgaagctgaaagaccatc

SEQ ID NO: 602 - DNA, 20 bp, Artificial Sequence
  Description of Artificial Sequence: Synthetic primer
cgaggttgggactgagaact

SEQ ID NO: 603 - DNA, 22 bp, Artificial Sequence
  Description of Artificial Sequence: Synthetic primer
tgctgagtaggtggaagttctc

SEQ ID NO: 604 - DNA, 20 bp, Artificial Sequence
  Description of Artificial Sequence: Synthetic primer
gcacatgggttcctaccagt

SEQ ID NO: 605 - DNA, 20 bp, Artificial Sequence
  Description of Artificial Sequence: Synthetic primer
atcctctggctggatgaaga

SEQ ID NO: 606 - DNA, 20 bp, Artificial Sequence
  Description of Artificial Sequence: Synthetic primer
catgcacaactgcgtatcaa

SEQ ID NO: 607 - DNA, 20 bp, Artificial Sequence
  Description of Artificial Sequence: Synthetic primer
acggtcggaaagctacagat

SEQ ID NO: 608 - DNA, 20 bp, Artificial Sequence
  Description of Artificial Sequence: Synthetic primer
accctgcagcttctctgaac

SEQ ID NO: 609 - DNA, 20 bp, Artificial Sequence
  Description of Artificial Sequence: Synthetic primer
cctctctccaccgagctatc

SEQ ID NO: 610 - DNA, 20 bp, Artificial Sequence
  Description of Artificial Sequence: Synthetic primer
cgtggtccttgttgtctcag

SEQ ID NO: 611 - DNA, 20 bp, Artificial Sequence
  Description of Artificial Sequence: Synthetic primer
gtgttggaatacgcgacaga

SEQ ID NO: 612 - DNA, 18 bp, Artificial Sequence
  Description of Artificial Sequence: Synthetic primer
ggggtggtgctgaagagc

SEQ ID NO: 613 - DNA, 20 bp, Artificial Sequence
  Description of Artificial Sequence: Synthetic primer
gagggcctcttgtgatggta

SEQ ID NO: 614 - DNA, 20 bp, Artificial Sequence
  Description of Artificial Sequence: Synthetic primer
tccctggagacccagataag

SEQ ID NO: 615 - DNA, 20 bp, Artificial Sequence
  Description of Artificial Sequence: Synthetic primer
tgccaagctctgagaaactg

SEQ ID NO: 616 - DNA, 20 bp, Artificial Sequence
  Description of Artificial Sequence: Synthetic primer
ggcttgggcttcacatctat

SEQ ID NO: 617 - DNA, 20 bp, Artificial Sequence
  Description of Artificial Sequence: Synthetic primer
aggaagtgggtgaccttcat

SEQ ID NO: 618 - DNA, 20 bp, Artificial Sequence
  Description of Artificial Sequence: Synthetic primer
cataaatgcttgcccatctg

SEQ ID NO: 619 - DNA, 20 bp, Artificial Sequence
  Description of Artificial Sequence: Synthetic primer
tcaaagccacagggatgtag

SEQ ID NO: 620 - DNA, 20 bp, Artificial Sequence
  Description of Artificial Sequence: Synthetic primer
tccttctccatccaggtttc

SEQ ID NO: 621 - DNA, 20 bp, Artificial Sequence
  Description of Artificial Sequence: Synthetic primer
tagagggacttccagccaac

SEQ ID NO: 622 - DNA, 20 bp, Artificial Sequence
  Description of Artificial Sequence: Synthetic primer
aagaggcgtcttctgcaaat

SEQ ID NO: 623 - DNA, 20 bp, Artificial Sequence
  Description of Artificial Sequence: Synthetic primer
ggcttgtctgctgtctcttg

SEQ ID NO: 624 - DNA, 20 bp, Artificial Sequence
  Description of Artificial Sequence: Synthetic primer
gctgtcgatcttggtgtctg

SEQ ID NO: 625 - DNA, 20 bp, Artificial Sequence
  Description of Artificial Sequence: Synthetic primer
ttcggatgttcatcctgtgt

SEQ ID NO: 626 - DNA, 20 bp, Artificial Sequence
  Description of Artificial Sequence: Synthetic primer
ttgattgttgggatggtcac

SEQ ID NO: 627 - DNA, 20 bp, Artificial Sequence
  Description of Artificial Sequence: Synthetic primer
ctggaaaagccacctttttg

SEQ ID NO: 628 - DNA, 20 bp, Artificial Sequence
  Description of Artificial Sequence: Synthetic primer
aaacaaacggagggaaagtg

SEQ ID NO: 629 - DNA, 20 bp, Artificial Sequence
  Description of Artificial Sequence: Synthetic primer
gtggaggcacaaggaggtat

SEQ ID NO: 630 - DNA, 20 bp, Artificial Sequence
  Description of Artificial Sequence: Synthetic primer
ttagaccaggcaatcccttc

SEQ ID NO: 631 - DNA, 20 bp, Artificial Sequence
  Description of Artificial Sequence: Synthetic primer
ggctcaaggaggagagtcag

SEQ ID NO: 632 - DNA, 20 bp, Artificial Sequence
  Description of Artificial Sequence: Synthetic primer
agggctatgctgtccatctt

SEQ ID NO: 633 - DNA, 20 bp, Artificial Sequence
  Description of Artificial Sequence: Synthetic primer
catctcgaagcagaaccaag

SEQ ID NO: 634 - DNA, 20 bp, Artificial Sequence
  Description of Artificial Sequence: Synthetic primer
gatgctgagtggaaccaatg

SEQ ID NO: 635 - DNA, 22 bp, Artificial Sequence
  Description of Artificial Sequence: Synthetic primer
gagcaagcagatattcccattt

SEQ ID NO: 636 - DNA, 20 bp, Artificial Sequence
  Description of Artificial Sequence: Synthetic primer
caggttgttggttccaaatg

SEQ ID NO: 637 - DNA, 20 bp, Artificial Sequence
  Description of Artificial Sequence: Synthetic primer
tagtctggcctcctccaact

SEQ ID NO: 638 - DNA, 20 bp, Artificial Sequence
  Description of Artificial Sequence: Synthetic primer
tgtctgtgcagcaagcataa

SEQ ID NO: 639 - DNA, 21 bp, Artificial Sequence
  Description of Artificial Sequence: Synthetic primer
tccattcctcgagcagatact

SEQ ID NO: 640 - DNA, 21 bp, Artificial Sequence
  Description of Artificial Sequence: Synthetic primer
cccgagaatatcatgtccagt

SEQ ID NO: 641 - DNA, 20 bp, Artificial Sequence
  Description of Artificial Sequence: Synthetic primer
gcacgctgttgtatgcagat

SEQ ID NO: 642 - DNA, 20 bp, Artificial Sequence
  Description of Artificial Sequence: Synthetic primer
cttgctttatgggctcaaga

SEQ ID NO: 643 - DNA, 20 bp, Artificial Sequence
  Description of Artificial Sequence: Synthetic primer
tcttcctctggctcaccttt

SEQ ID NO: 644 - DNA, 20 bp, Artificial Sequence
  Description of Artificial Sequence: Synthetic primer
ctatgaccctgccgtcctac

SEQ ID NO: 645 - DNA, 22 bp, Artificial Sequence
  Description of Artificial Sequence: Synthetic primer
tgggcagatgaatagcaataag

SEQ ID NO: 646 - DNA, 20 bp, Artificial Sequence
  Description of Artificial Sequence: Synthetic primer
cgttcatacaagcaggctct

SEQ ID NO: 647 - DNA, 20 bp, Artificial Sequence
  Description of Artificial Sequence: Synthetic primer
gatggtcactggtggcatta

SEQ ID NO: 648 - DNA, 20 bp, Artificial Sequence
  Description of Artificial Sequence: Synthetic primer
caaagaccccagtggtgagt

SEQ ID NO: 649 - DNA, 20 bp, Artificial Sequence
  Description of Artificial Sequence: Synthetic primer
gggatcctgtttcctttcaa

SEQ ID NO: 650 - DNA, 20 bp, Artificial Sequence
  Description of Artificial Sequence: Synthetic primer
cctctgcgctttcatagaca

SEQ ID NO: 651 - DNA, 20 bp, Artificial Sequence
  Description of Artificial Sequence: Synthetic primer
tgcactgaagtcgaaggttt

SEQ ID NO: 652 - DNA, 20 bp, Artificial Sequence
  Description of Artificial Sequence: Synthetic primer
ttgcgttctccttctctgtg

SEQ ID NO: 653 - DNA, 20 bp, Artificial Sequence
  Description of Artificial Sequence: Synthetic primer
gctgctgcaataggtcttca

SEQ ID NO: 654 - DNA, 20 bp, Artificial Sequence
  Description of Artificial Sequence: Synthetic primer
gtgtttgcggatgatctgtt

SEQ ID NO: 655 - DNA, 20 bp, Artificial Sequence
  Description of Artificial Sequence: Synthetic primer
accgggacagcaagttattc

SEQ ID NO: 656 - DNA, 20 bp, Artificial Sequence
  Description of Artificial Sequence: Synthetic primer
actgcaatgggaagaccaat

SEQ ID NO: 657 - DNA, 21 bp, Artificial Sequence
  Description of Artificial Sequence: Synthetic primer
gttcccgtacagcactgactt

SEQ ID NO: 658 - DNA, 20 bp, Artificial Sequence
  Description of Artificial Sequence: Synthetic primer
gcaaagttgcaaaggtgatg

SEQ ID NO: 659 - DNA, 21 bp, Artificial Sequence
  Description of Artificial Sequence: Synthetic primer
aacactgctggacattggttt

SEQ ID NO: 660 - DNA, 22 bp, Artificial Sequence
  Description of Artificial Sequence: Synthetic primer
tcctcttctctcaactgctttg

SEQ ID NO: 661 - DNA, 21 bp, Artificial Sequence
  Description of Artificial Sequence: Synthetic primer
tccagacagtaccacaggaga

SEQ ID NO: 662 - DNA, 20 bp, Artificial Sequence
  Description of Artificial Sequence: Synthetic primer
gatagtgttcagggcggtgt

SEQ ID NO: 663 - DNA, 21 bp, Artificial Sequence
  Description of Artificial Sequence: Synthetic primer
cctttccctatcagctggagt

SEQ ID NO: 664 - DNA, 20 bp, Artificial Sequence
  Description of Artificial Sequence: Synthetic primer
ttgccttgccataacacatt

SEQ ID NO: 665 - DNA, 20 bp, Artificial Sequence
  Description of Artificial Sequence: Synthetic primer
gctgtagccctgaggacaag

SEQ ID NO: 666 - DNA, 20 bp, Artificial Sequence
  Description of Artificial Sequence: Synthetic primer
tccacgttccaaggtactga

SEQ ID NO: 667 - DNA, 21 bp, Artificial Sequence
  Description of Artificial Sequence: Synthetic primer
ggctgcagttcagaatttgtt

SEQ ID NO: 668 - DNA, 21 bp, Artificial Sequence
  Description of Artificial Sequence: Synthetic primer
tccttcatgcacttggtgata

SEQ ID NO: 669 - DNA, 20 bp, Artificial Sequence
  Description of Artificial Sequence: Synthetic primer
cctgtccacgagctcaatag

SEQ ID NO: 670 - DNA, 20 bp, Artificial Sequence
  Description of Artificial Sequence: Synthetic primer
gggagagagggctctcaata

SEQ ID NO: 671 - DNA, 20 bp, Artificial Sequence
  Description of Artificial Sequence: Synthetic primer
gactgcattggaactggatg

SEQ ID NO: 672 - DNA, 21 bp, Artificial Sequence
  Description of Artificial Sequence: Synthetic primer
ggttccagtggttcaggtagt

SEQ ID NO: 673 - DNA, 23 bp, Artificial Sequence
  Description of Artificial Sequence: Synthetic primer
gtgggttatgtgaaagtcaactg

SEQ ID NO: 674 - DNA, 20 bp, Artificial Sequence
  Description of Artificial Sequence: Synthetic primer
gagctgaaacagccagtcag

SEQ ID NO: 675 - DNA, 20 bp, Artificial Sequence
  Description of Artificial Sequence: Synthetic primer
gtgactggatccggaaagaa

SEQ ID NO: 676 - DNA, 20 bp, Artificial Sequence
  Description of Artificial Sequence: Synthetic primer
tcagttgaggtgcaagatcc

SEQ ID NO: 677 - DNA, 20 bp, Artificial Sequence
  Description of Artificial Sequence: Synthetic primer
tccagccaaaacaatagtgc

SEQ ID NO: 678 - DNA, 20 bp, Artificial Sequence
  Description of Artificial Sequence: Synthetic primer
cacaaaatcagggtcggtct

SEQ ID NO: 679 - DNA, 20 bp, Artificial Sequence
  Description of Artificial Sequence: Synthetic primer
ttccaagcgctcctgtaact

SEQ ID NO: 680 - DNA, 20 bp, Artificial Sequence
  Description of Artificial Sequence: Synthetic primer
gaaggaagggttcgttcttg

SEQ ID NO: 681 - DNA, 20 bp, Artificial Sequence
  Description of Artificial Sequence: Synthetic primer
tgggaaggtagaggttgtgg

SEQ ID NO: 682 - DNA, 20 bp, Artificial Sequence
  Description of Artificial Sequence: Synthetic primer
aacacccacaacatcttcca

SEQ ID NO: 683 - DNA, 20 bp, Artificial Sequence
  Description of Artificial Sequence: Synthetic primer
ggacagacacacagcattcc

SEQ ID NO: 684 - DNA, 20 bp, Artificial Sequence
  Description of Artificial Sequence: Synthetic primer
cactccaatgcaccacaaat

SEQ ID NO: 685 - DNA, 20 bp, Artificial Sequence
  Description of Artificial Sequence: Synthetic primer
catcaggcgacagattgaag

SEQ ID NO: 686 - DNA, 20 bp, Artificial Sequence
  Description of Artificial Sequence: Synthetic primer
aggtgtggtgcagacacttg

SEQ ID NO: 687 - DNA, 20 bp, Artificial Sequence
  Description of Artificial Sequence: Synthetic primer
tctgatgcgccagtttctaa

SEQ ID NO: 688 - DNA, 20 bp, Artificial Sequence
  Description of Artificial Sequence: Synthetic primer
ggcattgctgaaggctttac

SEQ ID NO: 689 - DNA, 20 bp, Artificial Sequence
  Description of Artificial Sequence: Synthetic primer
tctgccctagcctggtttac

SEQ ID NO: 690 - DNA, 20 bp, Artificial Sequence
  Description of Artificial Sequence: Synthetic primer
caggccagaccagtctacag

SEQ ID NO: 691 - DNA, 20 bp, Artificial Sequence
  Description of Artificial Sequence: Synthetic primer
tggacaatggactggttgag

SEQ ID NO: 692 - DNA, 20 bp, Artificial Sequence
  Description of Artificial Sequence: Synthetic primer
ctatgcagaaaggcaggtga

SEQ ID NO: 693 - DNA, 20 bp, Artificial Sequence
  Description of Artificial Sequence: Synthetic primer
tgacatgcgtttcatctgtc

SEQ ID NO: 694 - DNA, 22 bp, Artificial Sequence
  Description of Artificial Sequence: Synthetic primer
ccaagaggtactggactggaat

SEQ ID NO: 695 - DNA, 20 bp, Artificial Sequence
  Description of Artificial Sequence: Synthetic primer
gtggaaaggctggacaagtt

SEQ ID NO: 696 - DNA, 21 bp, Artificial Sequence
  Description of Artificial Sequence: Synthetic primer
tggacagcaacattgagaatc

SEQ ID NO: 697 - DNA, 23 bp, Artificial Sequence
  Description of Artificial Sequence: Synthetic primer
agcagaatgtaataccaccgttc

SEQ ID NO: 698 - DNA, 20 bp, Artificial Sequence
  Description of Artificial Sequence: Synthetic primer
ctggcagcaacatcttcaat

SEQ ID NO: 699 - DNA, 20 bp, Artificial Sequence
  Description of Artificial Sequence: Synthetic primer
actctgcgctgtgctatgac

SEQ ID NO: 700 - DNA, 20 bp, Artificial Sequence
  Description of Artificial Sequence: Synthetic primer
tatgatgggaaggaccgagt

SEQ ID NO: 701 - DNA, 20 bp, Artificial Sequence
  Description of Artificial Sequence: Synthetic primer
tgtctgtgcagcaagcataa

SEQ ID NO: 702 - DNA, 21 bp, Artificial Sequence
  Description of Artificial Sequence: Synthetic primer
ggaactttgtagggctggtct

SEQ ID NO: 703 - DNA, 20 bp, Artificial Sequence
  Description of Artificial Sequence: Synthetic primer
agagtctcagggttggcact

SEQ ID NO: 704 - DNA, 20 bp, Artificial Sequence
  Description of Artificial Sequence: Synthetic primer
tgccctcactgaagactgac

SEQ ID NO: 705 - DNA, 20 bp, Artificial Sequence
  Description of Artificial Sequence: Synthetic primer
atttcactgtccgctcctct

SEQ ID NO: 706 - DNA, 18 bp, Artificial Sequence
  Description of Artificial Sequence: Synthetic primer
ctgacgagcacgttccat

SEQ ID NO: 707 - DNA, 20 bp, Artificial Sequence
  Description of Artificial Sequence: Synthetic primer
gaacccagaccccgaattac

SEQ ID NO: 708 - DNA, 20 bp, Artificial Sequence
  Description of Artificial Sequence: Synthetic primer
ccggatctcctgtgtatgtg

SEQ ID NO: 709 - DNA, 20 bp, Artificial Sequence
  Description of Artificial Sequence: Synthetic primer
tagtcgctgcctgagagttg

SEQ ID NO: 710 - DNA, 20 bp, Artificial Sequence
  Description of Artificial Sequence: Synthetic primer
ctatttggccttcccattct

SEQ ID NO: 711 - DNA, 20 bp, Artificial Sequence
  Description of Artificial Sequence: Synthetic primer
aaaaaacccacctacacgat

SEQ ID NO: 712 - DNA, 20 bp, Artificial Sequence
  Description of Artificial Sequence: Synthetic primer
atctcgaagcagaaccaagt

SEQ ID NO: 713 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 714 - DNA, 2857 bp, Homo sapiens
ttttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcaaaaaaaaaaaaaaaaaaaaaaaaaaa

SEQ ID NO: 715 - DNA, 2272 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgtccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggggacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacagcacaaatatcaaaaaaaaaaaa

SEQ ID NO: 716 - DNA, 2189 bp, Homo sapiens
gcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 717 - DNA, 1100 bp, Homo sapiens
ggcctcccacttggttgctcgtacgcggctagtgggtcctcagtggatgtaggctgggcgccgcgatgttcgacgggacaccggcggagagcgacctcggggttaaggggtggggctggacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttataaggttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaaga

SEQ ID NO: 718 - DNA, 6641 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 719 - DNA, 1151 bp, Homo sapiens
ctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaaaaaaaaaaaaaaaaaaaaaaaaaaaa

SEQ ID NO: 720 - DNA, 1936 bp, Homo sapiens
ccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaaaaaaaaaaaaaaaaaaaaaaaaaaaa

SEQ ID NO: 721 - DNA, 3627 bp, Homo sapiens
atggagcggctgcgggacgtgcgggagcggctgcaggcgtgggagcgcgcgttccgacggcagcgcgggcggcgaccgagccaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctga

SEQ ID NO: 722 - DNA, 2154 bp, Homo sapiens
gccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaa

SEQ ID NO: 723 - DNA, 5765 bp, Homo sapiens
cagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattaaaaaaaaaaaaaaaaaaaa

SEQ ID NO: 724 - DNA, 2970 bp, Homo sapiens
ggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaagcttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaaaaa

SEQ ID NO: 725 - DNA, 5198 bp, Homo sapiens
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaagaaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagcagccgcccccgcctccccagcagcccccaccgcctccacctccgcagcagcaacagcagccgccacccccgcctcccccaccctccatgccgcagcaggcagccccggcgatgaagtcctcgcccccacccttcattgccacccaggtgcccgtcctggagccccagctcccaggcagcgtctttgaccccatcggccacttcacccagcccatcctgcacctgccgcagcctgagctgccccctcacctgccccagccgcctgagcacagcactccaccccatctcaaccagcacgcagtggtctctcctccagctttgcacaacgcactaccccagcagccatcacggcccagcaaccgagccgctgccctgcctcccaagcccgcccggcccccagccgtgtcaccagccttgacccaaacacccctgctcccacagccccccatggcccaacccccccaagtgctgctggaggatgaagagccacctgccccacccctcacctccatgcagatgcagctgtacctgcagcagctgcagaaggtgcagccccctacgccgctactcccttccgtgaaggtgcagtcccagcccccaccccccctgccgcccccaccccacccctctgtgcagcagcagctgcagcagcagccgccaccacccccaccaccccagccccagcctccaccccagcagcagcatcagccccctccacggcccgtgcacttgcagcccatgcagttttccacccacatccaacagcccccgccaccccagggccagcagcccccccatccgcccccaggccagcagccacccccgccgcagcctgccaagcctcagcaagtcatccagcaccaccattcaccccggcaccacaagtcggacccctactcaaccggtcacctccgcgaagccccctccccgcttatgatacattccccccagatgtcacagttccagagcctgacccaccagtctccaccccagcaaaacgtccagcctaagaaacaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggta

SEQ ID NO: 726 - DNA, 5243 bp, Homo sapiens
agcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttaaaaaaaaaaaaaaa

SEQ ID NO: 727 - DNA, 2304 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaacagagacagagggaagcctgagccaaaatagaccttcccgagagaggaggaagcccggagagagacgcacggtcccctccccgcccctaggccgccgccccctctctgccctcggcggcgagcagggcgccgcgacccggggccggaaaggtgccaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggaggccgagcaagcggaggcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaagggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 728 - DNA, 2337 bp, Homo sapiens
  modified_base (61): a, c, g, t, unknown, or other
  modified_base (2277): a, c, g, t, unknown, or other
cggaaggtgtgagccgcaaacccagcggagggcgggaagaaggaggaggcctctagggtgntcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggngctcacacctgtaatcctagcactttgggaggccaaggcgggtggatcacttgagaccag

SEQ ID NO: 729 - DNA, 2212 bp, Homo sapiens
tgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttc

SEQ ID NO: 730 - DNA, 4506 bp, Homo sapiens
gatcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttccctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataaaaaaaaaaaaaaaaagaaaaaaaaaaaaaaaa

SEQ ID NO: 731 - DNA, 1163 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 732 - DNA, 4975 bp, Homo sapiens; identical to SEQ ID NO: 161

SEQ ID NO: 733 - DNA, 5431 bp, Homo sapiens; identical to SEQ ID NO: 109

SEQ ID NO: 734 - DNA, 4740 bp, Homo sapiens
ttccggtttttctcaggggacgttgaaattatttttgtaacgggagtcgggagaggacggggcgtgccccgcgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcacgagttgacctagatgagatgtcgttcactttactgagctacagaaaaacatacgaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatcgaagattatttttggatcatgataaaactcttcagactgattctatagacagttttgaaacacagagaacaccacgaaaaagtaaccttgatgaagaggtgaatataattcctccacacactccagttaggactgttatgaacactatccaacaattaatgatgattttaaattctgcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgagtcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtc

SEQ ID NO: 735 - DNA, 3362 bp, Homo sapiens
tgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 736 - DNA, 4049 bp, Homo sapiens; identical to SEQ ID NO: 88

SEQ ID NO: 737 - DNA, 3754 bp, Homo sapiens
agcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagaaaaaaaaaaaaaaaaaa

SEQ ID NO: 738 - DNA, 3958 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 739 - DNA, 6156 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttccctgcattcaccttagtgcaacttagatctctcctccccaagtaaatgttgacaggccaatttcatacccatgtcagattgaatgtatttaaatgtatgtatttaaggagaaccatgctcttgttctgttcctgttcggttccagacactggtttcttgctttgttttccctggctaacagtctagtgccaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgttttt

SEQ ID NO: 740 - DNA, 5312 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 741 - DNA, 1966 bp, Homo sapiens
gaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccaaaaaaaaaaaaaaaaaa

SEQ ID NO: 742 - protein, 375 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 743 - protein, 693 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 744 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 745 - protein, 1342 aa, Homo sapiens; identical to SEQ ID NO: 198

SEQ ID NO: 746 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 747 - protein, 604 aa, Homo sapiens
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 748 - protein, 754 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 749 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 750 - protein, 429 aa, Homo sapiens
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKACQRKFSRSDHLKTHTRTHTGEKPFSCRWPSCQKKFARSDELVRHHNMHQRNMTKLQLAL

SEQ ID NO: 751 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 752 - protein, 280 aa, Homo sapiens
MAAVVALSLRRRLPATTLGGACLQASRGAQTAAATAPRIKKFAIYRWDPDKAGDKPHMQTYKVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 753 - protein, 1208 aa, Homo sapiens
MERLRDVRERLQAWERAFRRQRGRRPSQDDVEAAPEETRALYREYRTLKRTTGQAGGGLRSSESLPAAAEEAPEPRCWGPHLNRAATKSPQPTPGRSRQGSVPDYGQRLKANLKGTLQAGPALGRRPWPLGRASSKASTPKPPGTGPVPSFAEKVSDEPPQLPEPQPRPGRLQHLQASLSQRLGSLDPGWLQRCHSEVPDFLGAPKACRPDLGSEESQLLIPGESAVLGPGAGSQGPEASAFQEVSIRVGSPQPSSSGGEKRRWNEEPWESPAQVQQESSQAGPPSEGAGAVAVEEDPPGEPVQAQPPQPCSSPSNPRYHGLSPSSQARAGKAEGTAPLHIFPRLARHDRGNYVRLNMKQKHYVRGRALRSRLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGISTLLVLPTGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRVQRAFMQGQLRVVVATVAFGMGLDRPDVRAVLHLGLPPSFESYVQAVGRAGRDGQPAHCHLFLQPQGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARLQDWEDQVRCDIRQFLSLRPEEKFSSRAVARIFHGIGSPCYPAQVYGQDRRFWRKYLHLSFHALVGLATEELLQVAR

SEQ ID NO: 754 - protein, 165 aa, Homo sapiens
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 755 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIARVDLDEMSFTLLSYRKTYEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDRRLFLDHDKTLQTDSIDSFETQRTPRKSNLDEEVNIIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 756 - protein, 396 aa, Homo sapiens
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 757 - protein, 1362 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETEMAPKSKKKGHPGREQKKHHHHHHQQMQQAPAPVPQQPPPPPQQPPPPPPPQQQQQPPPPPPPPSMPQQAAPAMKSSPPPFIATQVPVLEPQLPGSVFDPIGHFTQPILHLPQPELPPHLPQPPEHSTPPHLNQHAVVSPPALHNALPQQPSRPSNRAAALPPKPARPPAVSPALTQTPLLPQPPMAQPPQVLLEDEEPPAPPLTSMQMQLYLQQLQKVQPPTPLLPSVKVQSQPPPPLPPPPHPSVQQQLQQQPPPPPPPQPQPPPQQQHQPPPRPVHLQPMQFSTHIQQPPPPQGQQPPHPPPGQQPPPPQPAKPQQVIQHHHSPRHHKSDPYSTGHLREAPSPLMIHSPQMSQFQSLTHQSPPQQNVQPKKQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLF

SEQ ID NO: 758 - protein, 188 aa, Homo sapiens [sequence omitted]

SEQ ID NO: 759 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 760 - protein, 1210 aa, Homo sapiens [sequence omitted]

SEQ ID NO: 761 - protein, 619 aa, Homo sapiens
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 762 - protein, 243 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 763 - protein, 1437 aa, Homo sapiens; identical to SEQ ID NO: 187

SEQ ID NO: 764 - protein, 577 aa, Homo sapiens
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 765 - protein, 520 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 766 - protein, 822 aa, Homo sapiens [sequence omitted]

SEQ ID NO: 767 - protein, 592 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 768 - protein, 400 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 769 - protein, 158 aa, Homo sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 770 - protein, 594 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 771 - DNA, 3445 bp, Homo sapiens
gagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaattgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaggaaaaaaaaaaaaaaaaa

SEQ ID NO: 772 - DNA, 4932 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccattagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaaaaaaaaaaaaaaaaaaaaaaaaaaaa

SEQ ID NO: 773 - DNA, 1876 bp, Homo sapiens
cgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgacggggctcacgcgcgggcccgccacggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacgtgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggataatgaggatatatgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatataaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaaaaaaaaaaaaaaaa

SEQ ID NO: 774 - DNA, 3046 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacaagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 775 - protein, 217 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALDNEDICQWNKMKYKSVYKNVILQVPVGLTVHTSLVCSVTLLITILCSTLILVAVFKYGHFSL

SEQ ID NO: 776 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 777 - protein, 926 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILQVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 778 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 779 - DNA, 4673 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtcctctcctttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 780 - DNA, 2348 bp, Homo sapiens
cctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaaaaaaaaaaaaaaaaaaaaaaaaaaaaaaaaaaaaaaaaaaaa

SEQ ID NO: 781 - DNA, 849 bp, Homo sapiens; identical to SEQ ID NO: 107

SEQ ID NO: 782 - DNA, 2507 bp, Homo sapiens; identical to SEQ ID NO: 85

SEQ ID NO: 783 - DNA, 5977 bp, Homo sapiens
gcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 784 - DNA, 3769 bp, Homo sapiens
ggggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcgggaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttatagtaaagttgatttttttaaagggggaggggaaggctttaatgtgttctagatcaatttataccttccgtatgacgttttactctgatatcattgtgcactttagccagatccagaaaacactcaaatttattttgcaacaagtgagagcccaggagacctccttattatcctgtctctgctttgaggcaatcaagtaccctctctgaacctaggttccctcatctgtaaaacaaaggtttcagaccagatggtgtttaaggtttctccccatactggaatgaatgatttcttggtggtattagcatcatcacagacctatacttgctttctgaaactctaccacatactgaaggaatacaggaatgggattaagatgactagcatagcagtgtacagcttgaagagatgttccacatcatcactccagctccttctcttttctcagggacaaatgaggcccagagagaatacgacctgtgtaaggtcaaacagtggcagggaaagaaggagagctggggtttagcattctccctggtgaagattggaggtccaaagaaatgactcctttttaagggatgggcataaaaaagtgatcaaaacattgcaaaggagaatcaaagattgattgtcctggggctaagaaagaagataatttttaaagaatgggagtgggcaacagtgaaaaatattgcagataagtagataaggatagaagatcaaccactgactggtagta

SEQ ID NO: 785 - DNA, 758 bp, Homo sapiens
ccccgccgccggccgccgtgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaatagttttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgcttttattttttgcagtcttcaatttgagaaaggtgagaaataatgttttccaataaatgagattcataccattaaaaaaaaaaaaaaaaaa

SEQ ID NO: 786 - DNA, 4190 bp, Homo sapiens; identical to SEQ ID NO: 102

SEQ ID NO: 787 - DNA, 1483 bp, Homo sapiens
gccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagagaactcccatcagcagcgcccgacagcactctcctcctcactgcccaacactgggtggcaaatcttttcatcttggccactctgataggctggacagtgaggtccttcttcctagggcgcatggaaacctgttgcagtcacctgggtttgcggagtgggaggaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccacca

SEQ ID NO: 788 - DNA, 3537 bp, Homo sapiens; identical to SEQ ID NO: 132

SEQ ID NO: 789 - DNA, 12563 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagcttatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggcacgcgggaatgtgaagggcgctccgggctctgagcccgcagcttttacgacttctccctgcgtcgttccttatattcacagaagccccatagtttcactgggttgcggttattttcctggtagtttgcgtgtaagaaagggagaatatagttttagaggaagctgaactatgacgatgctgggcgaacggtttgggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggaggccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgattttttttt

SEQ ID NO: 790 - DNA, 2717 bp, Homo sapiens; identical to SEQ ID NO: 135

SEQ ID NO: 791 - DNA, 3497 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 792 - DNA, 5431 bp, Homo sapiens; identical to SEQ ID NO: 109

SEQ ID NO: 793 - DNA, 1890 bp, Homo sapiens
cccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaaaaaaa

SEQ ID NO: 794 - DNA, 1600 bp, Homo sapiens
cggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtagtctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatcccaaaaaaaaaaaaaaaaaaaaaaaaaaaaaaaa

SEQ ID NO: 795 - DNA, 1019 bp, Homo sapiens
gaggcgacgccgcggtccgcgctgatctccaggcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaaaaaaaaaaaaaaaaaaaaaaaaaaaaaaaaaaa

SEQ ID NO: 796 - DNA, 3312 bp, Homo sapiens
acagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatacttta

SEQ ID NO: 797 - DNA, 4559 bp, Homo sapiens; identical to SEQ ID NO: 157

SEQ ID NO: 798 - DNA, 5198 bp, Homo sapiens; identical to SEQ ID NO: 725

SEQ ID NO: 799 - DNA, 3457 bp, Homo sapiens; identical to SEQ ID NO: 84

SEQ ID NO: 800 - DNA, 740 bp, Homo sapiens
ggcagagccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggaaaaaaaaaaaaaaaaaaaaaaaaaaaaaaaaaaaa

SEQ ID NO: 801 - DNA, 3883 bp, Homo sapiens
gaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgacagtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctacagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggccttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtatgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaatttttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttatgattgagctgtattaccataagtagaattttaagtaaactggtgaatttgggccatagatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttaaaaaaaaaaaaaaaaaaaaaaaaaaaaaaaaaaaaaaaaaaaaaaaaagaaaaaaaaaaaaaaaaa

SEQ ID NO: 802 - DNA, 1035 bp, Homo sapiens
gcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataaaaaaaaaaaaaaaaaaa

SEQ ID NO: 803 - DNA, 1654 bp, Homo sapiens
gtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagtcctgttaatgtatttcttcccaaacaattcatttttctcttctaaaggtagtctttcccaactgactgtagggttgtgtcttttcccaattaagtatctgcagaactttgggattatactttgtttactgtagaaagataataaaaagagttgtccaaaaaaaaaaaaaaaaaaaaaaaaaaaaaaaaaaaaaaaaaaa

SEQ ID NO: 804 - DNA, 1399 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgctccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaaaaaa

SEQ ID NO: 805 - DNA, 2714 bp, Homo sapiens
agctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagactaaaaaaaaaaaaaaaaaaaaa

SEQ ID NO: 806 - DNA, 2921 bp, Homo sapiens
ccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagcctctactttcttcttgccacctttttgtggcaatattaaagtgaactgctaatagtgtaagtatgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttaaaaaaaaaaaaaaaaaaaaa

SEQ ID NO: 807 - DNA, 984 bp, Homo sapiens
cggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 808 - DNA, 1148 bp, Homo sapiens
gctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtc

SEQ ID NO: 809 - DNA, 417 bp, Homo sapiens
gtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttga

SEQ ID NO: 810 - DNA, 4889 bp, Homo sapiens; identical to SEQ ID NO: 86

SEQ ID NO: 811 - DNA, 3685 bp, Homo sapiens; identical to SEQ ID NO: 117

SEQ ID NO: 812 - DNA, 831 bp, Homo sapiens
ccatcttccggtctcctcagaagtcgcttagctcttcggtggttgtcccacgtccggaggcctagccgtcgcttacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaaa

SEQ ID NO: 813 - DNA, 3754 bp, Homo sapiens; identical to SEQ ID NO: 737

SEQ ID NO: 814 - protein, 707 aa, Homo sapiens; identical to SEQ ID NO: 235

SEQ ID NO: 815 - protein, 747 aa, Homo sapiens; identical to SEQ ID NO: 229

SEQ ID NO: 816 - protein, 1104 aa, Homo sapiens; identical to SEQ ID NO: 220

SEQ ID NO: 817 - protein, 727 aa, Homo sapiens; identical to SEQ ID NO: 197

SEQ ID NO: 818 - protein, 476 aa, Homo sapiens [sequence omitted]

SEQ ID NO: 819 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 820 - protein, 454 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 821 - protein, 519 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 822 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 823 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVVCHPNGQKLFVYDPNNPPSSEVLRIQNILSEKPTVTTVYANNGSVLQGSSVASVYDGKLLIGTLYHRALYCEL

SEQ ID NO: 824 - protein, 212 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 825 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 826 - protein, 250 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 827 - protein, 377 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 828 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 829 - protein, 51 aa, Homo sapiens
MVAYWRQAGLSYIRYSQICAKAVRDALKTEFKANAEKTSGSNVKIVKVKKE

SEQ ID NO: 830 - protein, 125 aa, Homo sapiens
MDHKPLLQERPPAYNLEAGQGDYACGPHGYGAIPAAPPPPPYPYLVTGIPTHHPRVYNIHSRTVTRYPANSIVVVGGCPVCRVGVLEDCFTFLGIFLAIILFPFGFICCFALRKRRCPNCGATFA

SEQ ID NO: 831 - protein, 910 aa, Homo sapiens
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 832 - protein, 252 aa, Homo sapiens
MKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 833 - protein, 334 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCELAGVETCKSLESQKERLLSNGWETASAVDMMELYNRLPRAEVSRIESLEFLDEMDVLEQLNAHYCLCWATKGGNELGLKEITY

SEQ ID NO: 834 - protein, 151 aa, Homo sapiens
MPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPAQQQQPCLYEIKQFLECAQNQGDIKLCEGFNEVLKQCRLANGLA

SEQ ID NO: 835 - protein, 1362 aa, Homo sapiens; identical to SEQ ID NO: 757

SEQ ID NO: 836 - protein, 175 aa, Homo sapiens; identical to SEQ ID NO: 237

SEQ ID NO: 837 - protein, 1437 aa, Homo sapiens; identical to SEQ ID NO: 187

SEQ ID NO: 838 - protein, 754 aa, Homo sapiens; identical to SEQ ID NO: 212

SEQ ID NO: 839 - protein, 522 aa, Homo sapiens
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 840 - protein, 179 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 841 - protein, 276 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 842 - protein, 833 aa, Homo sapiens; identical to SEQ ID NO: 205

SEQ ID NO: 843 - protein, 396 aa, Homo sapiens; identical to SEQ ID NO: 756

SEQ ID NO: 844 - protein, 797 aa, Homo sapiens
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDSANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 845 - protein, 179 aa, Homo sapiens
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 846 - protein, 233 aa, Homo sapiens; identical to SEQ ID NO: 182

SEQ ID NO: 847 - protein, 246 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 848 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

We claim:

1. A method of treating a subject afflicted with cancer comprising administering to the subject a modulator that specifically modulates the amount and/or activity of Wolf-Hirschhorn syndrome candidate 1-like 1 (WHSC1L1), wherein the modulator is a nucleic acid molecule that is complementary to WHSC1L1, thereby treating a subject afflicted with cancer.

2. A method of treating a subject afflicted with cancer comprising administering to the subject a compound which specifically inhibits the amount and/or activity of WHSC1L1 which is amplified in cancer, wherein the compound is a nucleic acid molecule that is complementary to WHSC1L1, thereby treating a subject afflicted with cancer.

3. The method of claim 2, wherein said compound is administered in a pharmaceutically acceptable formulation.

4. The method of claim 2, wherein said compound is an RNA interfering agent which inhibits expression of WHSC1L1.

5. The method of claim 4, wherein said RNA interfering agent is an siRNA molecule or an shRNA molecule.

6. The method of claim 2, wherein said compound is an antisense oligonucleotide complementary to WHSC1L1.

7. The method of claim 2, wherein said compound is an aptamer which inhibits expression or activity of WHSC1L1.

* * * * *